US008778634B2

(12) United States Patent
Foster et al.

(10) Patent No.: US 8,778,634 B2
(45) Date of Patent: Jul. 15, 2014

(54) NON-CYTOTOXIC PROTEIN CONJUGATES

(75) Inventors: Keith Foster, Salisbury (GB); John Chaddock, Salisbury (GB); Charles Penn, Salisbury (GB); Kei Roger Aoki, Irvine, CA (US); Joseph Francis, Irvine, CA (US); Lance Steward, Irvine, CA (US)

(73) Assignees: Syntaxin, Ltd., Abingdon (GB); Allergan, Inc., Irvine, CA (US)

( * ) Notice: Subject to any disclaimer, the term of this patent is extended or adjusted under 35 U.S.C. 154(b) by 92 days.

(21) Appl. No.: 13/418,453

(22) Filed: Mar. 13, 2012

(65) Prior Publication Data

US 2012/0207735 A1 Aug. 16, 2012

Related U.S. Application Data

(63) Continuation-in-part of application No. 11/791,979, filed as application No. PCT/GB2005/004598 on Dec. 1, 2005, now Pat. No. 8,187,834.

(30) Foreign Application Priority Data

| | | |
|---|---|---|
| Dec. 1, 2004 | (GB) | 0426394.3 |
| Mar. 10, 2005 | (GB) | 0504964.8 |
| Mar. 10, 2005 | (GB) | 0504966.3 |

(51) Int. Cl.

| | |
|---|---|
| ***A61K 39/08*** | (2006.01) |
| ***C12P 21/04*** | (2006.01) |
| ***C07K 14/00*** | (2006.01) |

(52) U.S. Cl.
USPC ........................ 435/69.1; 424/239.1; 530/350

(58) Field of Classification Search
USPC ..................... 424/94.3, 239.1; 435/188, 69.7; 536/23.4; 530/350
See application file for complete search history.

(56) References Cited

U.S. PATENT DOCUMENTS

| | | | |
|---|---|---|---|
| 5,668,255 | A | 9/1997 | Murphy |
| 5,989,545 | A | 11/1999 | Foster |
| 5,998,375 | A | 12/1999 | Thøgersen et al. |
| 6,136,564 | A | 10/2000 | Kopetzki |
| 6,395,513 | B1 | 5/2002 | Foster |
| 6,461,617 | B1 | 10/2002 | Shone |
| 6,632,440 | B1 | 10/2003 | Quinn |
| 6,776,990 | B2 | 8/2004 | Sachs |
| 6,843,998 | B1 | 1/2005 | Steward |
| 6,962,703 | B2 | 11/2005 | Foster |
| 7,052,702 | B1 | 5/2006 | Duggan |
| 7,056,729 | B2 | 6/2006 | Donovan |
| 7,132,259 | B1 | 11/2006 | Dolly |
| 7,192,596 | B2 | 3/2007 | Shone |
| 7,208,466 | B1 | 4/2007 | Foster et al. |
| 7,244,436 | B2 | 7/2007 | Donovan |
| 7,244,437 | B2 | 7/2007 | Donovan |
| 7,262,291 | B2 | 8/2007 | Donovan |
| 7,276,473 | B2 | 10/2007 | Sachs |
| 7,413,742 | B2 | 8/2008 | Donovan |
| 7,419,676 | B2 | 9/2008 | Dolly |
| 7,422,877 | B2 | 9/2008 | Dolly |
| 7,452,543 | B2 | 11/2008 | Chaddock |
| 7,494,661 | B2 | 2/2009 | Sanders |
| 7,514,088 | B2 | 4/2009 | Steward |
| 7,658,933 | B2 | 2/2010 | Foster et al. |
| 7,659,092 | B2 | 2/2010 | Foster et al. |
| 7,709,228 | B2 | 5/2010 | Dolly |
| 7,736,659 | B2 | 6/2010 | Donovan |
| 7,740,868 | B2 | 6/2010 | Steward |
| 7,749,514 | B2 | 7/2010 | Steward |
| 7,780,968 | B2 | 8/2010 | Donovan |
| 7,785,606 | B2 | 8/2010 | Ichtchenko |
| 7,811,584 | B2 | 10/2010 | Steward et al. |
| 7,833,535 | B2 | 11/2010 | Donovan |
| 7,887,810 | B2 | 2/2011 | Foster |
| 7,892,560 | B2 | 2/2011 | Foster |
| 7,897,157 | B2 | 3/2011 | Steward |

(Continued)

FOREIGN PATENT DOCUMENTS

| | | |
|---|---|---|
| EP | 1 422 240 A2 | 5/2004 |
| EP | 1422240 | 5/2004 |

(Continued)

OTHER PUBLICATIONS

Blanc, Jacky P. et al., Examination of the Requirement for an Amphiphilic Helical Structure in B-Endorphin through the Design, Synthesis, and Study of Model Peptides, The Journal of Biological Chemistry, vol. 258, No. 13, 1983, pp. 8277-8284.

Shone, Clifford C. et al., A 50-kDa fragment from the NH2-terminus of the heavy subunit of *Clostridium botulinum* type A neurotoxin forms channels in lipid vesicles, Eur. J. Biochem. 167, 175-180, 1987.

Wagner, Ernst et al., Influenza virus hemagglutinin HA-2 N-terminal fusogenic peptides augment gene transfer by transferrin-polylysine-DNA complexes: Toward a synthetic virus-like gene-transfer vehicle, Proc. Natl. Acad. Sci, USA, vol. 89, pp. 7934-7938, 1992.

(Continued)

*Primary Examiner* — Chih-Min Kam
(74) *Attorney, Agent, or Firm* — Roylance, Abrams, Berdo & Goodman, L.L.P.

(57) ABSTRACT

The present invention is directed to non-cytotoxic protein conjugates for inhibition or reduction of exocytic fusion in a nociceptive sensory afferent cell. The protein conjugates comprise: (i) a Targeting Moiety (TM), wherein the TM is an agonist of a receptor present on a nociceptive sensory afferent cell, and wherein the receptor undergoes endocytosis to be incorporated into an endosome within the nociceptive sensory afferent cell; (ii) a non-cytotoxic protease or a fragment thereof, wherein the protease or protease fragment is capable of cleaving a protein of the exocytic fusion apparatus of the nociceptive sensory afferent cell; and (iii) a Translocation Domain, wherein the Translocation Domain translocates the protease or protease fragment from within the endosome, across the endosomal membrane, and into the cytosol of the nociceptive sensory afferent cell wherein the Targeting Moiety is selected from the group consisting of BAM, β-endorphin, bradykinin, substance P, dynorphin and/or nociceptin.

8 Claims, 39 Drawing Sheets

(56) References Cited

U.S. PATENT DOCUMENTS

| | | | | |
|---|---|---|---|---|
| 8,067,200 | B2 | 11/2011 | Foster et al. | |
| 8,187,834 | B2 | 5/2012 | Foster et al. | |
| 8,399,400 | B2 | 3/2013 | Foster et al. | |
| 8,399,401 | B2 | 3/2013 | Foster et al. | |
| 8,455,203 | B2 * | 6/2013 | Wang et al. | 435/7.1 |
| 8,512,984 | B2 | 8/2013 | Foster et al. | |
| 2003/0049264 | A1 | 3/2003 | Foster et al. | |
| 2003/0180289 | A1 | 9/2003 | Foster | |
| 2004/0071736 | A1 | 4/2004 | Quinn | |
| 2004/0115727 | A1 | 6/2004 | Steward | |
| 2005/0095251 | A1 | 5/2005 | Steward | |
| 2005/0244435 | A1 | 11/2005 | Shone | |
| 2006/0051356 | A1 | 3/2006 | Foster | |
| 2006/0110410 | A1 | 5/2006 | Shone | |
| 2006/0216283 | A1 | 9/2006 | Foster | |
| 2007/0010447 | A1 | 1/2007 | Quinn | |
| 2007/0010475 | A1 | 1/2007 | Richardson | |
| 2007/0066559 | A1 | 3/2007 | Richardson | |
| 2007/0184048 | A1 | 8/2007 | Foster | |
| 2007/0184070 | A1 | 8/2007 | Shone | |
| 2007/0248626 | A1 | 10/2007 | Shone | |
| 2008/0025994 | A1 | 1/2008 | Steward | |
| 2008/0032928 | A1 | 2/2008 | Quinn | |
| 2008/0032931 | A1 | 2/2008 | Steward | |
| 2008/0038274 | A1 | 2/2008 | Foster | |
| 2008/0070278 | A1 | 3/2008 | North | |
| 2008/0182294 | A1 | 7/2008 | Dolly | |
| 2008/0311622 | A1 | 12/2008 | Dolly | |
| 2009/0004224 | A1 | 1/2009 | Steward | |
| 2009/0005313 | A1 | 1/2009 | Steward | |
| 2009/0018081 | A1 | 1/2009 | Steward | |
| 2009/0030182 | A1 | 1/2009 | Dolly | |
| 2009/0030188 | A1 | 1/2009 | Dolly | |
| 2009/0042270 | A1 | 2/2009 | Dolly | |
| 2009/0069238 | A1 | 3/2009 | Steward | |
| 2009/0081730 | A1 | 3/2009 | Dolly | |
| 2009/0087458 | A1 | 4/2009 | Dolly | |
| 2009/0104234 | A1 | 4/2009 | Francis | |
| 2009/0117157 | A1 | 5/2009 | Brin | |
| 2009/0162341 | A1 | 6/2009 | Foster et al. | |
| 2010/0034802 | A1 | 2/2010 | Foster | |
| 2010/0055761 | A1 | 3/2010 | Seed | |
| 2010/0196421 | A1 | 8/2010 | Ichtchenko | |
| 2010/0209955 | A1 | 8/2010 | Olyer | |
| 2010/0303757 | A1 | 12/2010 | Francis | |
| 2010/0303789 | A1 | 12/2010 | Francis | |
| 2010/0303791 | A1 | 12/2010 | Francis | |
| 2011/0091437 | A1 | 4/2011 | Foster | |

FOREIGN PATENT DOCUMENTS

| | | | |
|---|---|---|---|
| JP | 11-504006 | | 4/1990 |
| JP | 2003-522199 | | 7/2003 |
| JP | 2003-543906 | | 12/2005 |
| JP | 2007-543908 | | 12/2005 |
| WO | 96/33273 | | 10/1996 |
| WO | WO 96/33273 | | 10/1996 |
| WO | WO 97/07208 | | 2/1997 |
| WO | WO 98/07864 | | 2/1998 |
| WO | WO 99/17806 | | 4/1999 |
| WO | WO 00/57897 | | 10/2000 |
| WO | WO 01/14570 | A1 | 3/2001 |
| WO | 01/58936 | | 8/2001 |
| WO | WO 02/07759 | A3 | 1/2002 |
| WO | WO 2004/024909 | A2 | 3/2004 |
| WO | WO 2005/023309 | A2 | 3/2005 |
| WO | 2006/026780 | | 3/2006 |
| WO | 2006/059093 | | 6/2006 |
| WO | 2006/059105 | | 6/2006 |
| WO | 2006/059113 | | 6/2006 |
| WO | WO 2006/059113 | | 6/2006 |
| WO | 2007/138339 | | 12/2007 |
| WO | WO 2010/105236 | A1 * | 9/2010 |
| WO | 2012/156743 | | 11/2012 |

OTHER PUBLICATIONS

Plank, Christian et al., The Influence of Endosome-disruptive Peptides on Gene Transfer Using Synthetic Virus-like Gene Transfer Systems, The Journal of Biological Chemistry, vol. 269, No. 17, 1994, pp. 12918-12924.

Dooley, Colette T., et al., Binding and In Vitro Activities of Peptides with High Affinity for the Nociceptin/Orphanin FQ Receptor, ORL1, The Journal of Pharmacology and Experimental Therapeutics, 1997, vol. 283, No. 2, pp. 735-741.

Vergnollie, N. et al., Proteinase-activated receptor-2 and hyperalgesia: A novel pain pathway, Nature Medicine, vol. 7, No. 7, 2001, pp. 821-826.

Rizzi, Daniela et al., [Arg14, LYS15]Nociceptin, a Highly Potent Agonist of the Nociceptin/Orphanin FQ Receptor: in Vitro and in Vivo Studies, The Journal of Pharmacology and Experimental Therapeutics, 2002, vol. 300, No. 1 pp. 57-63.

Turton, Kathryn et al., Botulinum and tetanus neurotoxins: structure, function and therapeutic utility, Trends in Biochemical Sciences, vol. 27, No. 11, 2002, pp. 552-558.

Maile, Rebecca et al., Effects of nociceptin and analogues of nociceptin upon spontaneous dorsal root activity recorded from an in vitro preparation of rat spinal cord, Neuroscience Letters 350 (2003) 190-192.

Chaddock, John A. et al., Manipulation of Signal Transduction by Botulinum Neurotoxins and their Derivatives, Current Signal Transduction Therapy, 2007, 2, 221-225.

Guerrini, Remo et al., Address and Message Sequences for the Nociceptin Receptor: A Structure-Activity Study of Nociceptin-(1-13)-peptide amide, J. Med. Chem., 1997, 40, 1789-1793.

Schiavo, Giampietro et al., Neurotoxins Affecting Neuroexocytosis, Physiological Reviews, vol. 80, No. 2, 2000, pp. 717-766.

Xu, X.J. et al., Galanin and spinal nociceptive mechanisms: recent advances and therapeutic implications, Neuropeptides, 2000, 34(3 &4), 137-147.

Okada, Kazushi et al., Highly Potent Nociceptin Analog Containing the Arg-Lys Triple Repeat, Biochemical and Biophysical Research Communications, 278, 493-498, 2000.

Mogil, Jeffrey S. et al., The Molecular and Behavioral Pharmacology of the Orphanin FQ/Nociceptin Peptide and Receptor Family, Pharmacological Reviews, 2001, vol. 53, No. 3, pp. 381-415.

Chaddock, J.A., et al., A Conjugate Composed of Nerve Growth Factor Coupled to a Non-Toxic Derivative of *Clostridium botulinum* Neurotoxin Type A Can Inhibit Neurotransmitter Release In Vitro, Growth Factors 18(2):147-155, 2000.

Chaddock, J.A., et al., Expression and Purification of Catalytically Active, Non-Toxic Endopeptidase Derivatives of *Clostridium botulinum* Toxin Type A, Protein Expression and Purification 25(2):219-228, 2002.

Chaddock, J.A., et al., Inhibition of Vesicular Secretion in Both Neuronal and Nonneuronal Cells by Retargeted Endopeptidase Derivative of *Clostridium botulinum* Neurotoxin Type A, Infection and Immunity 68(5):2587-2593, 2000.

Cui, M., et al., Retargeted Clostridial Endopeptidase: Antinociceptive Activity in Preclinical Models of Pain, Naunyn-Schmiedeberg's Archives of Pharmacology:R16, 2002.

Duggan, M.J., et al., Inhibition of Release of Neurotransmitters from Rat Dorsal Root Ganglia by a Novel Conjugate of a *Clostridium botulinum* Toxin A Endopeptidase Fragment and *Erythrina cristagalli* Lectin, Journal of Biological Chemistry 277(38):34846-34852, 2002.

Foster, K.A., et al., Re-Engineering the Target Specificity of Clostridial Neurotoxins: A Route to Novel Therapeutics, Neurotoxicity Research 9(2,3):101-107, 2006.

Inoue, M., et al., Nociceptin/Orphannin FQ-Induced Nociceptive Responses Through Substance P Release From Peripheral Nerve Endings in Mice, PNAS (Proceedings of the National Academy of Sciences USA), 95 (18):10949-10953, 1998.

Sutton, J.M., et al., Preparation of Specifically Activatable Endopeptidase Derivatives of *Clostridium botulinum* Toxins Type A, B, and C and Their Applications, Protein Expression and Purification 40(1):31-41, 2005.

(56) References Cited

OTHER PUBLICATIONS

English Translation of Japanese Office Action issued Feb. 19, 2013, from the Japanese Patent Office in related Japanese Patent Application No. JP 2011-258137.
U.S. Appl. No. 13/212,868, filed Aug. 18, 2011, Pending.
Canadian Office Action issued Apr. 26, 2013, from the Canadian Patent Office in related Canadian Patent Application No. 2,588,292.
U.S. Appl. No. 12/862,948, filed Aug. 25, 2010, Pending.
U.S. Appl. No. 13/239,573, filed Sep. 22, 2011, Pending.
English Translation of Office Action issued Jun. 26, 2012 in JP 2007-543906.
English Translation of Office Action issued Jun. 26, 2012 in JP 2007-543908.
English Translation of Office Action issued Jun. 29, 2012 in CN 200780028089.0.
Chinese Office Action issued Mar. 25, 2013, from the Chinese Patent Office in related Chinese Patent Application No. 200780028089.0, and English translation.
Office Action issued Sep. 10, 2012 in EP 10 166 556.0.
Office Action issued Sep. 10, 2012 in EP 10 184 150.0.
Office Action issued Sep. 10, 2012 in EP 10 184 114.6.
Office Action issued Sep. 10, 2012 in EP 05 810 711.1.
Office Action issued Aug. 22, 2012 in CA 2,595,115.
Translation of Japanese Office Action dated Jun. 28, 2011 in JP 2007-543906.
Translation of Japanese Office Action dated Jun. 28, 2011 in JP 2007-543908.
Sagane et al., Dichain structure of botulinum neurotoxin : Identification of cleavage sites in Types C, D, and F neurotoxin molecules, J. Protein Chemistry 18(8) :855-892 (1999).
Chaddock, et al., "Retargeted Clostridial Endopeptidases: Inhibition of Nociceptive Neurotransmitter Release In Vitro, and Antinociceptive Activity in In Vivo Models of Pain," Movement Disorders, vol. 19, pp. 542-547; Sep. 8, 2004.
Okada et al., *Biochem. Biophys. Res. Comm.* 278 :493-498 (2000).
U.S. Appl. No. 11/798,610, Quinn.
U.S. Appl. No. 08/513,878, filed Dec. 1, 1995, North.
U.S. Appl. No. 09/572,431, filed May 17, 2000, North.
U.S. Appl. No. 11/819,648, filed Jun. 28, 2007, Foster.
U.S. Appl. No. 13/774,587, filed Feb. 22, 2013, Pending.
U.S. Appl. No. 13/072,865, filed Mar. 28, 2011, Pending.
U.S. Appl. No. 13/343,892, filed Jan. 5, 2012, Pending.
U.S. Appl. No. 13/944,427, filed Jul. 17, 2013, Pending.
U.S. Appl. No. 12/303,078, filed Sep. 21, 2009, Abandoned.
U.S. Appl. No. 12/868,510, filed Aug. 25, 2010, Abandoned.
U.S. Appl. No. 13/419,381, Mar. 13, 2012, Pending.
U.S. Appl. No. 13/360,565, filed Jan. 27, 2012, Pending.
U.S. Appl. No. 13/595,927, Pending.
Office Action dated Nov. 7, 2013, from the Australian Patent Office in related Australian Patent Application No. 2012203056.
Office Action dated Nov. 7, 2013, from the Australian Patent Office in related Australian Patent Application No. 2012203055.
Office Action dated Oct. 29, 2013, from the Japanese Patent Office in related Japanese Patent Application No. 2011-258137, and English translation.
Office Action dated Jul. 29, 2013, from the Mexican Patent Office in related Mexican Patent Application No. Application No. MX/a/2008/015227, and English summary thereof.
Crasto, C. et al., Linker: a program to generate linker sequences for fusion proteins, Protein Engineering, 2000, vol. 13, No. 5, pp. 309-312.
Smith, D. et al., Improved amino acid flexibility parameters, Protein Science, 2003, vol. 12, No. 5, pp. 1060-1072.
International Search Report and Written Opinion dated Dec. 20, 2013 in related PCT Application No. PCT/GB2013/052243.

* cited by examiner

CPN-A on eDRG for 1 Day

Duration of action following eDRG exposure for 1 Day

| Parameters for MrgX1 receptor targeted chimaera: pEC50, % BAM (8-22) Emax and % BAM (8-22) Emax at 1 μM | | | |
|---|---|---|---|
| Construct | pEC50 | % BAM (8-22) Emax | % Emax at 1 μM |
| CPBAM1-22 | N/A | N/A | 81.93 ± 4.68 |
| CPBAM8-22 | 7.08 ± 0.24a | 108.25 ± 11.26 | N/R |
| CTBAM1-22 | 8.37 ± 0.20a | 108.58 ± 5.50 | N/R |
| CTBAM8-22 | N/A | N/A | 83.15 ± 9.08 |
| | | | |

Figure 39

Caspaicin Induced Thermal Hyperalgesia

| Fusion | Dose (i.pl) | Mean MPE ± SEM (n) |
|---|---|---|
| CPBAM1-22 | 25ng | 13.4 ± 0.6% (6) |
| CPBAM8-22 | 25ng | 26.2 ± 1.4% (6) |

Figure 40

Caspaicin Thermal Hyperalgesia Screen

| Fusion protein | $ED_{50}$ (ng/rat ± SEM) |
|---|---|
| BAM8-22 fusion | 127 ± 48.2 |
| B-endorphin fusion | 55.7 ±21.7 |
| Substance P analogue 'S6' | 219.9 ± 82.8 |
| Dynorphin | 7.3 ± 3.6 |
| Nociceptin fusion | 164.7 ± 62.2 |

| $pIC_{50}$ ± s.e. mean |
|---|
| 6.92 ± 0.04 |

| $pIC_{50}$ ± s.e. mean |
|---|
| 7.03 ± 0.02 |

| $pIC_{50}$ ± s.e. mean |
|---|
| 7.01 ± 0.01 |

CPBE fusion: Max cleavage 23%, $ED_{50}$ 38nm

Figure 43

Caspaicin Induced Paw Guarding Assay

| Fusion | Dose (i.pl) | % Inhibition ± SEM (n) |
|---|---|---|
| CPBE (serotype A) | 25ng | 27.1 ± 9.2 (6) |
| CPBE (serotype B) | 25ng | 24.5 ± 9.0% (6) |

Figure 44

Caspaicin Induced Thermal Hyperalgesia

| Fusion | Dose (i.pl) | MPE (%) |
|---|---|---|
| CPBE (serotype A) | 25ng | 18.7 ± 2.7 |
| CPBE (serotype B) | 25ng | 16.5 ± 2.3 |
| CPBE (serotype D) | 25ng | 38.2 ± 5.1 |

| Construct | Emax ± SEM | $pEC_{50}$ ± SEM | $EC_{50}$ (pM) | $n_H$± SEM |
|---|---|---|---|---|
| Bradykinin fusion | 119.32 ± 13.13 | -8.48 ± 0.17 | 3330 | 1.33 ± 0.34 |

Figure 46

Caspaicin Induced Paw Guarding Assay

| Fusion | Dose (i.pl) | % Inhibition ± SEM (n) |
|---|---|---|
| Bradykinin | 2.5ng | 4.7 ± 2.0 (5) |
| Bradykinin | 25ng | 12.2 ± 4.5% (6) |

Figure 47

Caspaicin Induced Thermal Hyperalgesia Assay

| Fusion | Dose (i.pl) | Mean MPE ± SEM (n) |
|---|---|---|
| Bradykinin | 25ng | 36.3 ± 1.1%(6) |

NON-CYTOTOXIC PROTEIN CONJUGATES

NAMES OF PARTIES TO A JOINT RESEARCH AGREEMENT

Allergan, Inc., a Delaware Corporation, and Syntaxin, Ltd., a United Kingdom corporation, are parties to a Joint Research Agreement.

FIELD OF THE INVENTION

This invention relates to a non-cytotoxic protein conjugate, and to the use of said conjugate for treating pain.

BACKGROUND OF THE INVENTION

Toxins may be generally divided into two groups according to the type of effect that they have on a target cell. In more detail, the first group of toxins kill their natural target cells, and are therefore known as cytotoxic toxin molecules. This group of toxins is is exemplified inter alia by plant toxins such as ricin, and abrin, and by bacterial toxins such as diphtheria toxin, and *Pseudomonas* exotoxin A. Cytotoxic toxins typically kill their target cells by inhibiting the cellular process of protein synthesis.

In contrast, the second group of toxins, which are known as non-cytotoxic toxins, do not (as their name confirms) kill their natural target cells. Non-cytotoxic toxins have attracted much less commercial interest than have their cytotoxic counterparts, and exert their effects on a target cell by inhibiting cellular processes other than protein synthesis. As with their cytotoxic counterparts, non-cytotoxic toxins are produced from a variety of sources such as plants, and bacteria. Bacterial non-cytotoxic toxins are now described in more detail.

Clostridial neurotoxins are proteins that typically have a molecular mass of the order of 150 kDa. They are produced by various species of bacteria, especially of the genus *Clostridium*, most importantly *C. tetani* and several strains of *C. botulinum, C. butyricum* and *C. argentinense*. There are at present eight different classes of the clostridial neurotoxin, namely: tetanus toxin, and botulinum neurotoxin in its serotypes A, B, $C_1$, D, E, F and G, and they all share similar structures and modes of action.

Clostridial neurotoxins represent a major group of non-cytotoxic toxin molecules, and are synthesised by the host bacterium as single polypeptides that are modified post-translationally by a proteolytic cleavage event to form two polypeptide chains joined together by a disulphide bond. The two chains are termed the heavy chain (H-chain), which has a molecular mass of approximately 100 kDa, and the light chain (L-chain), which has a molecular mass of approximately 50 kDa.

L-chains possess a protease function (zinc-dependent endopeptidase activity) and exhibit high substrate specificity for vesicle and/or plasma membrane associated proteins involved in the exocytic process. L-chains from different clostridial species or serotypes may hydrolyse different but specific peptide bonds in one of three substrate proteins, namely synaptobrevin, syntaxin or SNAP-25. These substrates are important components of the neurosecretory machinery.

Non-cytotoxic toxins are also produced by other bacteria, such as from the genus *Neisseria*, most importantly from the species *N. gonorrhoeae*. For example, *Neisseria* sp. produces the non-cytotoxic toxin IgA protease (see WO99/58571).

It has been well documented in the art that toxin molecules may be re-targeted to a cell that is not the toxin's natural target cell. When so re-targeted, the modified toxin is capable of binding to a desired target cell and, following subsequent translocation into the cytosol, is capable of exerting its effect on the target cell. Said re-targeting is achieved by replacing the natural Targeting Moiety (TM) of the toxin with a different TM. In this regard, the TM is selected so that it will bind to a desired target cell, and allow subsequent passage of the modified toxin into an endosome within the target cell. The modified toxin also comprises a translocation domain to enable entry of the non-cytotoxic protease into the cell cytosol. The translocation domain can be the natural translocation domain of the toxin or it can be a different translocation domain obtained from a microbial protein with translocation activity.

For example, in the context of non-cytotoxic toxin molecules, it has been well documented that a clostridial neurotoxin may be re-targeted by incorporation of a Targeting Moiety (TM), which is not the natural TM of a clostridial neurotoxin. The described chemical conjugation and recombinant methodologies are now regarded as conventional, and reference is made to Hermanson, G. T. (1996), Bioconjugate techniques, Academic Press, and to Wong, S. S. (1991), Chemistry of protein conjugation and cross-linking, CRC Press.

For example, WO94/21300 describes modified clostridial neurotoxin molecules that are capable of regulating Integral Membrane Protein (IMP) density present at the cell surface of the target cell. The modified neurotoxin molecules are thus capable of controlling cell activity (e.g. glucose uptake) of the target cell. WO96/33273 and WO99/17806 describe modified clostridial neurotoxin molecules that target peripheral sensory afferents. The modified neurotoxin molecules are thus capable of demonstrating an analgesic effect. WO00/10598 describes the preparation of modified clostridial neurotoxin molecules that target mucus hypersecreting cells (or neuronal cells controlling said mucus hypersecreting cells), which modified neurotoxins are capable of inhibiting hypersecretion from said cells. WO01/21213 describes modified clostridial neurotoxin molecules that target a wide range of different types of non-neuronal target cells. The modified molecules are thus capable of preventing secretion from the target cells. Additional publications in the technical field of re-targeted toxin molecules include: WO00/62814; WO00/04926; U.S. Pat. No. 5,773,586; WO93/15766; WO00/61192; and WO99/58571.

Thus, from the above-described publications, it will be appreciated that the basic concept of re-targeting a non-cytotoxic protease to a desired target cell, by selecting a TM that has a corresponding receptor present on the target cell, has been well documented.

However, different receptors present on a target cell of interest demonstrate different binding affinities for different TMs. This may be a particular problem with pain-sensing cells, which possess a wide range of receptor types having different binding affinities for different TMs. Thus, a re-targeted conjugate comprising a particular TM (that binds to a receptor on a pain-sensing cell) may demonstrate a low binding affinity for a pain-sensing target cell, which is undesirable.

There is therefore a need to develop modified non-cytotoxic conjugates that address one or more of the above problems. Of particular interest is the development of an improved conjugate for use in treating pain.

SUMMARY OF THE INVENTION

The present invention seeks to address one or more of the above problems by providing unique non-cytotoxic protein conjugates. In one embodiment, the Targeting Moiety (TM) component employed with a non-cytotoxic protein conjugate of the present invention is an "agonist" of a receptor that is present on the pain-sensing target cell of interest. In one embodiment, the pain-sensing target cell is a nociceptive sensory afferent, for example a primary nociceptive sensory afferent.

Accordingly, in a first aspect, the present invention provides a non-cytotoxic conjugate for inhibition or reduction of exocytic fusion in a nociceptive sensory afferent cell, is comprising:

(i) a Targeting Moiety (TM), wherein said TM is capable of binding to a Binding site on a nociceptive sensory afferent cell, and wherein said Binding site undergoes endocytosis to be incorporated into an endosome within the nociceptive sensory afferent cell;

(ii) a non-cytotoxic protease or a fragment thereof, wherein the protease or protease fragment is capable of cleaving a protein of the exocytic fusion apparatus of said nociceptive sensory afferent cell; and (iii) a Translocation Domain, wherein the Translocation Domain translocates the protease or protease fragment from within the endosome, across the endosomal membrane, and into the cytosol of the nociceptive sensory afferent cell.

BRIEF DESCRIPTION OF THE DRAWINGS

SDS-PAGE analysis of expression and purification of recLH$_N$/B from *E. coli*. In FIG. 1, recLH$_N$/B is purified from cell paste using a three column strategy as described in Example 3. Protein samples are separated by SDS-PAGE and visualised by staining with simplyblue safestain coomassie reagent. Crude, soluble MBP-LH$_N$/B fusion protein contained within the clarified extract (lane 2) is loaded onto Q-Sepharose FF anion-exchange resin. Lane 3 represents recombinant MBP-LH$_N$/B fusion eluted from column at 150-200 mM salt. This sample is treated with factor Xa protease to remove MBP affinity tag (lane 4), and cleaved mixture diluted to lower salt concentration prior to loading onto a Q-Sepharose FF anion-exchange column. Material eluted between 120-170 mM salt was rich in LH$_N$/B (lane 5). Protein in lanes 6 and 8 represents LH$_N$/B harvested after treatment with enterokinase and final purification using Benzamidine Sepharose, under non-reducing and reducing conditions respectively. Lanes 1 and 7 represent molecular mass markers [Mark 12 (Invitrogen)].

SDS-PAGE analysis of expression and purification of LH$_N$/C from *E. coli*. In FIG. 2, recLH$_N$/C is purified from *E. coli* cell paste using a two-step strategy described in Example 4. Protein samples are separated by SDS-PAGE and visualised by staining with coomassie blue. Clarified Crude cell lysate (lane 2) is loaded onto Q-Sepharose FF anion-exchange resin. Fusion protein, MBP-LH$_N$/C is eluted with 0.1 M NaCl (lane 3). Eluted material incubated at 22° C. for 16 h with factor Xa protease (New England Biolabs) to cleave fusion tag MBP and nick recLH$_N$/C at the linker site. The protein of interest is further purified from cleaved fusion products (lane 4) using Q-Sepharose FF. Lanes 5 and 7 show purified recLH$_N$/C under non-reducing conditions and reduced with 10 mM DTT respectively, to illustrate disulphide bonding at the linker region between LC and H$_N$ domains after nicking with factor Xa. Lanes 1 and 6 represent molecular mass markers (shown in KDa); Mark 12 (Invitrogen).

SDS-PAGE analysis of expression and purification of N[1-17]-LH$_N$/A from *E. coli*. In FIG. 3, N[1-17]-LH$_N$/A is purified from *E. coli* BL21 cell paste using the methodology outlined in Example 9. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked [−] and [+] respectively.

Using the methodology outlined in Example 26, a LC/A-nociceptin-H$_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin is antisera (obtained from Abcam) were used as the primary antibody for Western blotting. The final purified material in the absence and presence of reducing agent is identified in the lanes marked [−] and [+] respectively.

Figure 5:
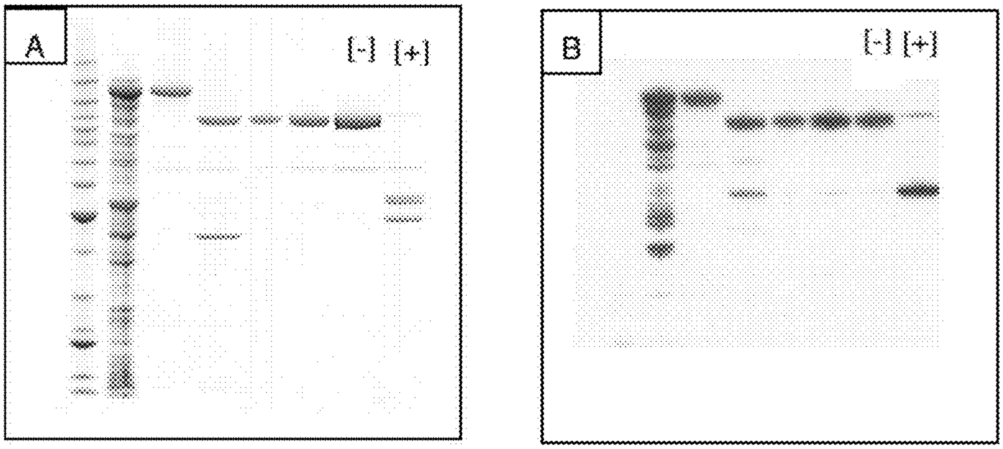

FIG. 5—Purification of a Nociceptin-LC/A-H$_N$/A Fusion Protein

Using the methodology outlined in Example 26, a nociceptin-LC/A-H$_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked [−] and [+] respectively.

Figure 6:
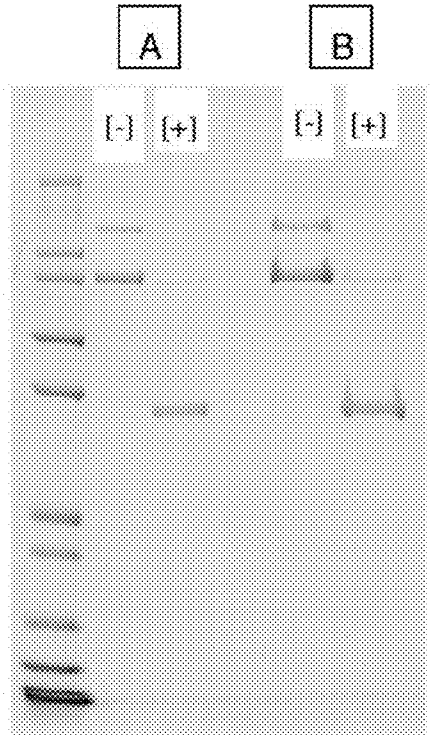

FIG. 6—Purification of a LC/C-Nociceptin-H$_N$/C Fusion Protein

Using the methodology outlined in Example 26, an LC/C-nociceptin-H$_N$/C fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE (Panel A) and Western blotting (Panel B). Anti-nociceptin antisera (obtained from Abcam) were used as the primary antibody for Western blotting. The final purified material in the absence and presence of reducing agent is identified in the lanes marked [−] and [+] respectively.

Figure 7:
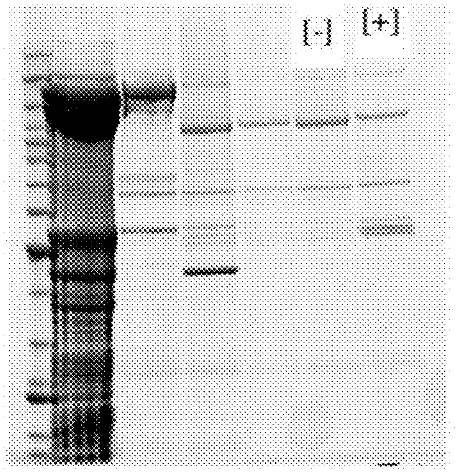

FIG. 7—Purification of a LC/A-met Enkephalin-$H_N$/A Fusion Protein

Using the methodology outlined in Example 26, an LC/A-met enkephalin-$H_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE. The final purified material in the absence and presence of reducing agent is identified in the lanes marked [−] and [+] respectively.

Figure 8:
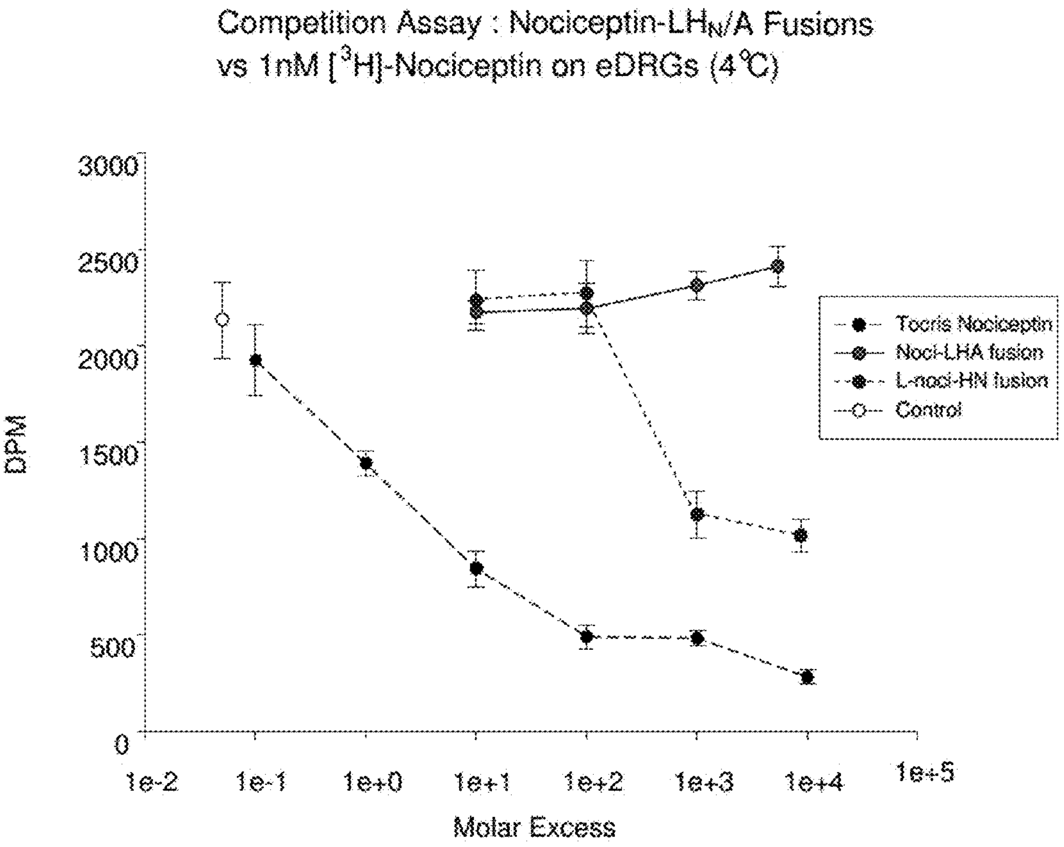

FIG. 8—Comparison of Binding Efficacy of a LC/A-Nociceptin-$H_N$/A Fusion Protein and a Nociceptin-LC/A-$H_N$/A Fusion Protein The ability of nociceptin fusions to bind to the $ORL_1$ receptor was assessed using a simple competition-based assay. Primary cultures of dorsal root ganglia (DRG) were exposed to varying concentrations of test material in the presence of 1 nM [3H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin-$H_N$/A fusion is far superior to the nociceptin-LC/A-$H_N$/A fusion at interacting with the $ORL_1$ receptor.

Figure 9:
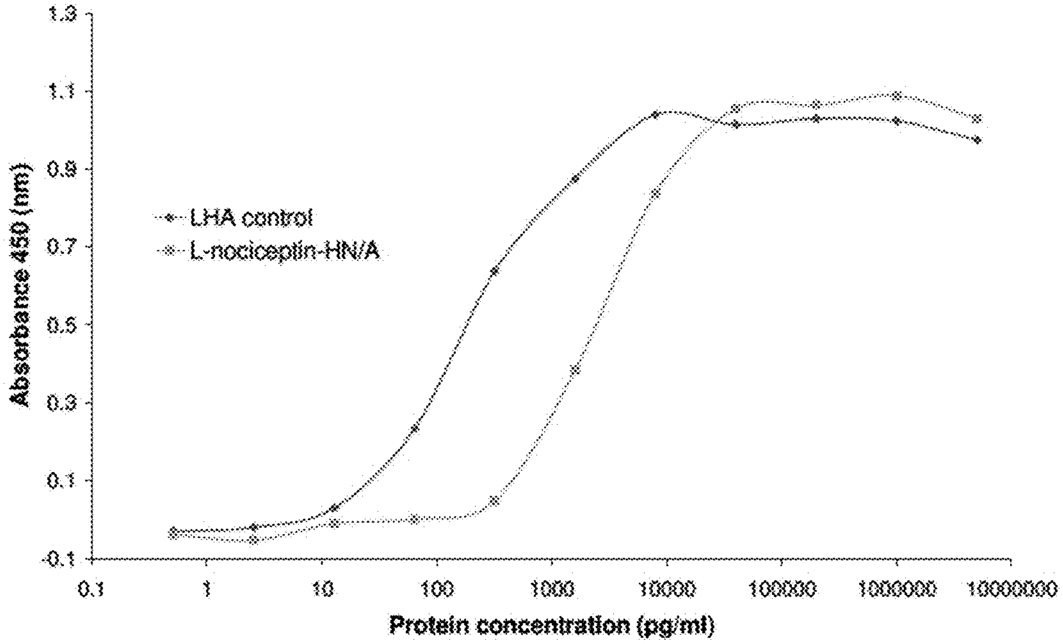

FIG. 9—In vitro catalytic activity of a LC/A-nociceptin-$H_N$/A fusion protein The in vitro endopeptidase activity of the purified LC/A-nociceptin-$H_N$/A fusion protein was determined essentially as described in Chaddock et al 2002, Prot. Express Purif. 25, 219-228. Briefly, SNAP-25 peptide immobilised to an ELISA plate was exposed to varying concentrations of fusion protein for 1 hour at 37° C. Following a series of washes, the amount of cleaved SNAP-25 peptide was quantified by reactivity with a specific antisera.

Figure 10:
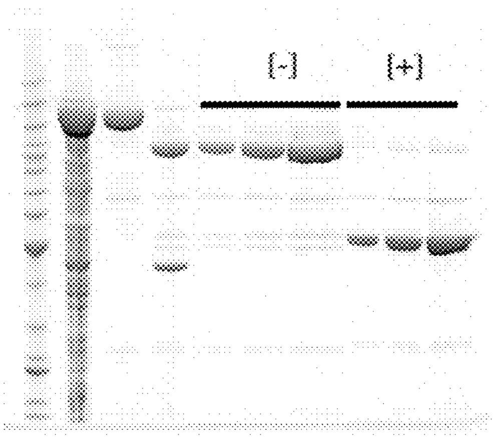

FIG. 10—Purification of a LC/A-Nociceptin Variant-$H_N$/A Fusion Protein

Using the methodology outlined in Example 26, an LC/A-nociceptin variant-$H_N$/A fusion protein was purified from *E. coli* BL21 cells. Briefly, the soluble products obtained following cell disruption were applied to a nickel-charged affinity capture column. Bound proteins were eluted with 100 mM imidazole, treated with Factor Xa to activate the fusion protein and remove the maltose-binding protein (MBP) tag, then re-applied to a second nickel-charged affinity capture column. Samples from the purification procedure were assessed by SDS-PAGE. The final purified material in the absence and presence of reducing agent is identified in the lanes marked [−] and [+] respectively.

Figure 11:
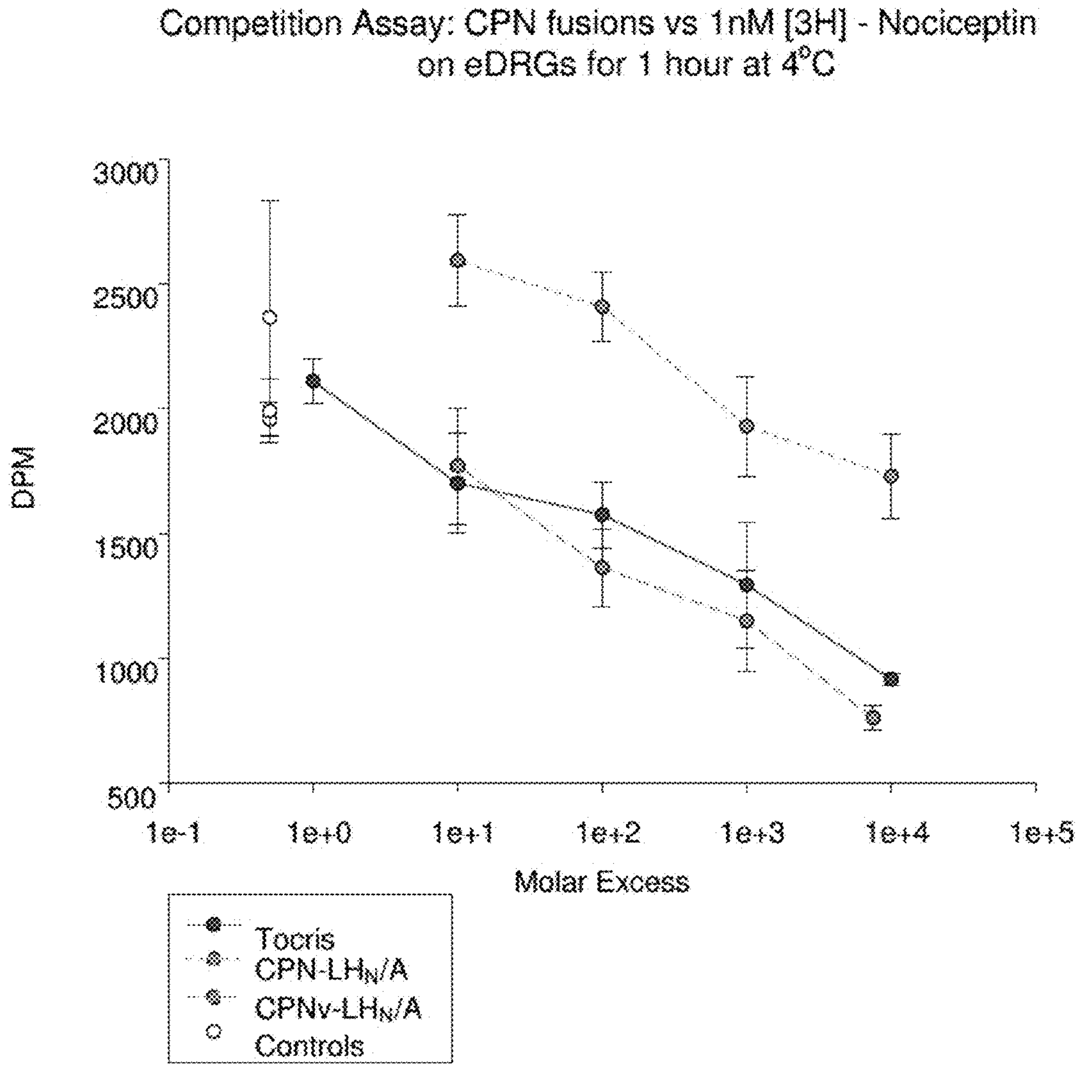

FIG. 11—Comparison of Binding Efficacy of a LC/A-Nociceptin-$H_N$/A Fusion Protein and a LC/A-Nociceptin Variant-$H_N$/A Fusion Protein The ability of nociceptin fusions to bind to the $ORL_1$ receptor was assessed using a simple competition-based assay. Primary cultures of dorsal root ganglia (DRG) were exposed to varying concentrations of test material in the presence of 1 nM [3H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin variant-$H_N$/A fusion (CPNv-LHA) is superior to the LC/A-nociceptin variant-$H_N$/A fusion (CPN-LHA) at interacting with the $ORL_1$ receptor.

Figure 12:
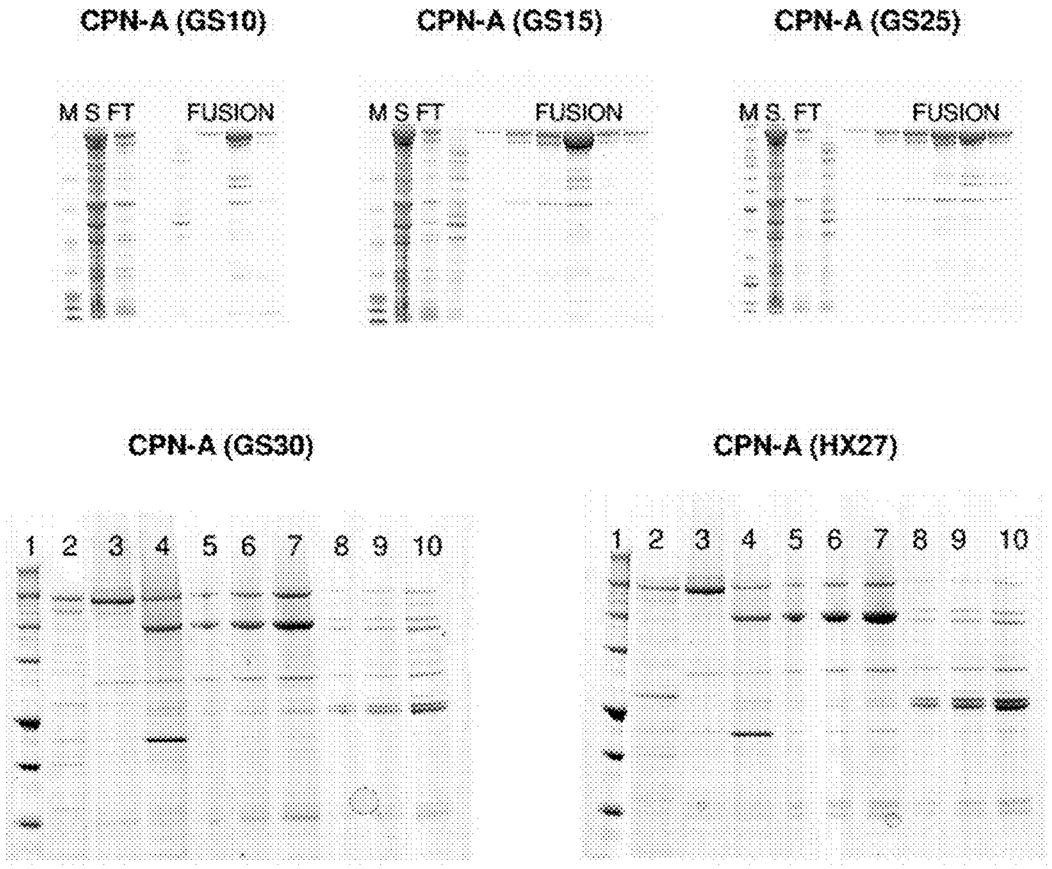

FIG. 12—Expressed/Purified LC/A-Nociceptin-$H_N$/A Fusion Protein Family with Variable Spacer Length Product(s)

Using the methodology outlined in Example 26, variants of the LC/A-CPN-$H_N$/A fusion consisting of GS10, GS30 and HX27 are purified from *E. coli* cell paste. Samples from the purification of LC/A-CPN(GS10)-$H_N$/A, LC/A-CPN (GS15)-$H_N$/A, LC/A-CPN(GS25)-$H_N$/A, LC/A-CPN (GS30)-$H_N$/A and LC/A-CPN(HX27)-$H_N$/A were assessed by SDS-PAGE prior to staining with Coomassie Blue. The electrophoresis profile indicates purification of a disulphide-bonded di-chain species of the expected molecular mass of CPBE-A. Top panel: M=benchmark molecular mass markers; S=total *E. coli* protein soluble fraction; FT=proteins that did not bind to the $Ni^{2+}$-charged Sepharose column; FUSION=fusion protein eluted by the addition of imidazole. Bottom panel: Lane 1=benchmark molecular mass markers; Lane 2=total *E. coli* protein soluble fraction; Lane 3=purified material following initial capture on $Ni^{2+}$-charged Sepharose; Lane 4=Factor Xa treated material prior to final capture on $Ni^{2+}$-charged Sepharose; Lane 5=purified final material post activation with Factor Xa (5 μl); Lane 6=purified final material post activation with Factor Xa (10 μl); Lane 7=purified final material post activation with Factor Xa (20 μl); Lane 8=purified final material post activation with Factor Xa+DTT (5 μl); Lane 9=purified final material post activation with Factor Xa+DTT (10 μl); Lane 10=purified final material post activation with Factor Xa+DTT (20 μl).

Figure 13:
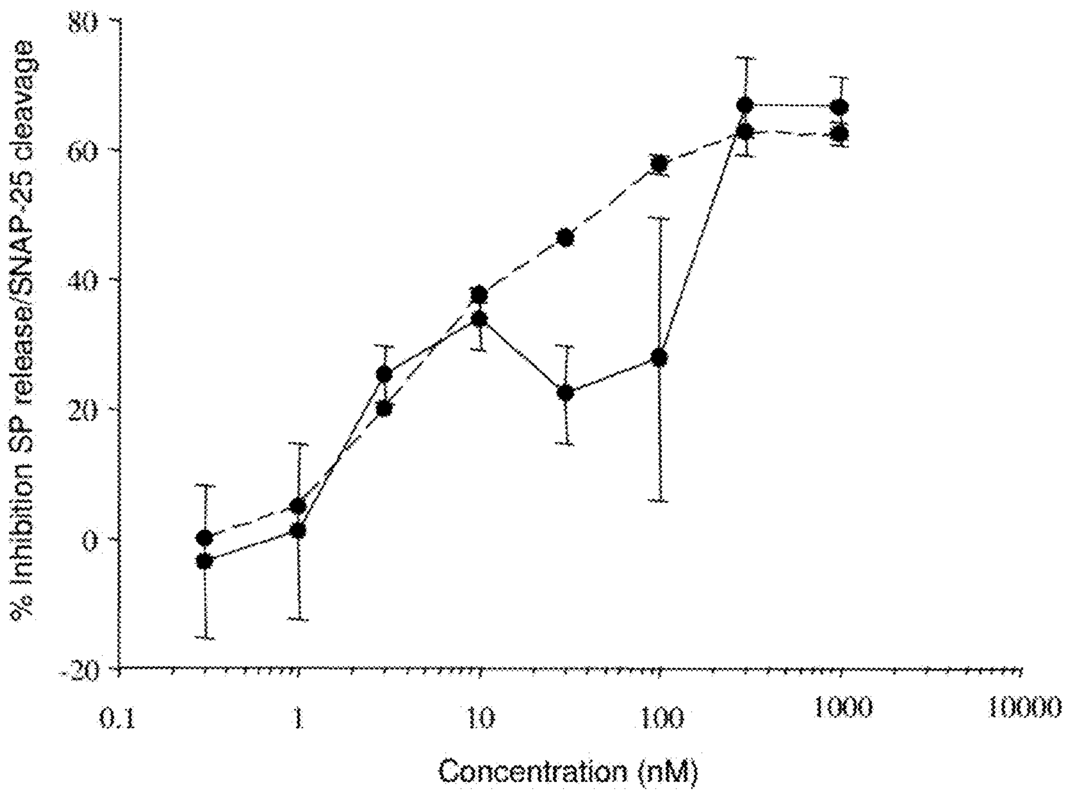

FIG. 13—Inhibition of SP Release and Cleavage of SNAP-25 by CPN-A

Briefly, primary cultures of dorsal root ganglia (DRG) were exposed to varying concentrations of CPN-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis and plotted against fusion concentration (dashed line). Material was also recovered for an analysis of substance P content using a specific EIA kit. Inhibition of substance P release is illustrated by the solid line. The fusion concentration required to achieve 50% maximal SNAP-25 cleavage is estimated to be 6.30±2.48 nM.

Figure 14:
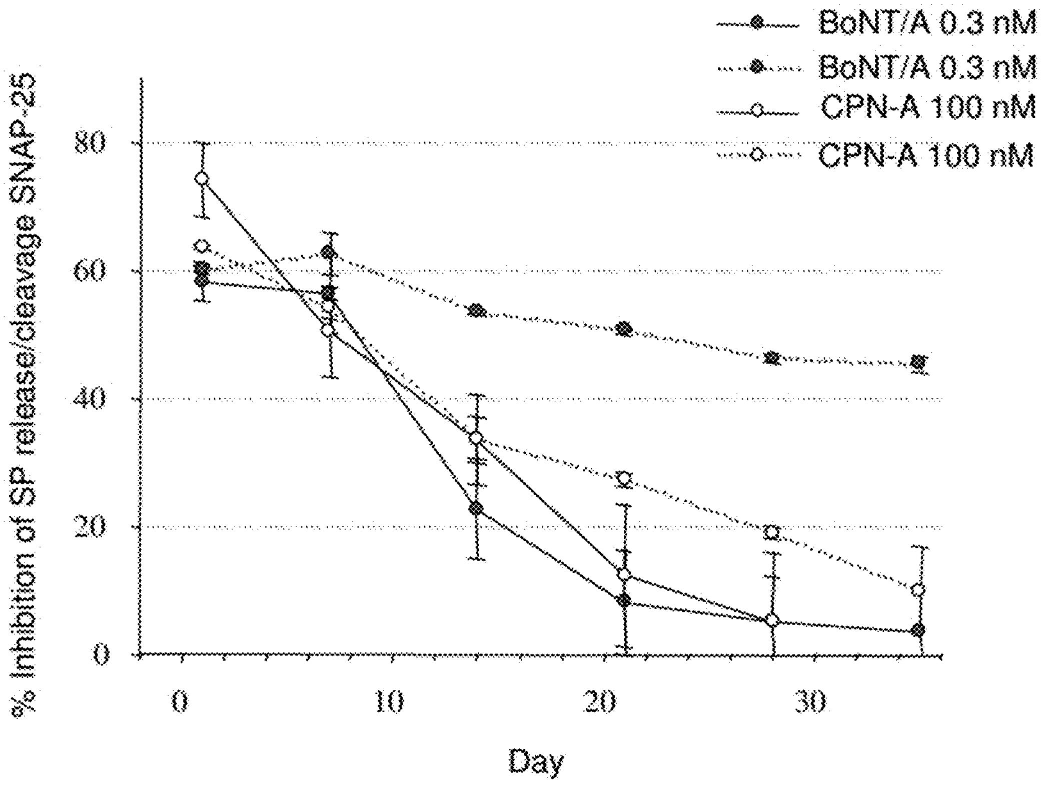

FIG. 14—Inhibition of SP Release and Cleavage of SNAP-25 Over Extended Time Periods after Exposure of DRG to CPN-A Primary cultures of dorsal root ganglia (DRG) were exposed to varying concentrations of CPN-A for 24 hours. Botulinum neurotoxin (BoNT/A) was used as a control. After this initial exposure, extracellular material was removed by washing, and the cells incubated at 37° C. for varying periods of time. At specific time points, cellular proteins were separated by SDS-PAGE, Western blotted, and probed with anti-SNAP-25 to facilitate an assessment of SNAP-25 cleavage. The percentage of cleaved SNAP-25 was calculated by densitometric analysis and illustrated by the dotted lines. Material was also recovered for an analysis of substance P content using a specific EIA kit. Inhibition of substance P release is illustrated by the solid lines.

Figure 15:
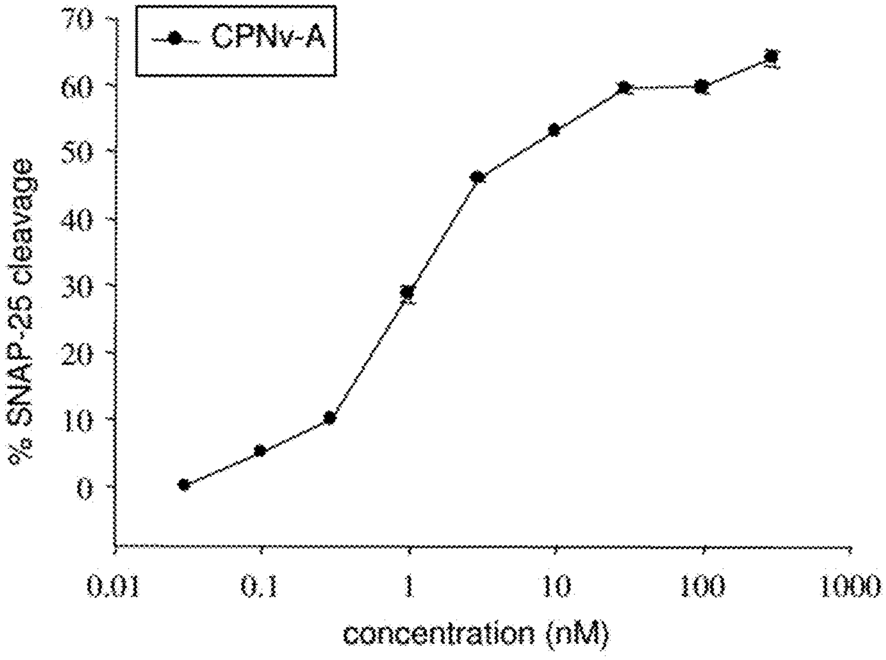

FIG. 15—Cleavage of SNAP-25 by CPNv-A

Primary cultures of dorsal root ganglia (DRG) were exposed to varying concentrations of CPNv-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. The fusion concentration required to achieve 50% maximal SNAP-25 cleavage is estimated to be 1.38±0.36 nM.

Figure 16:
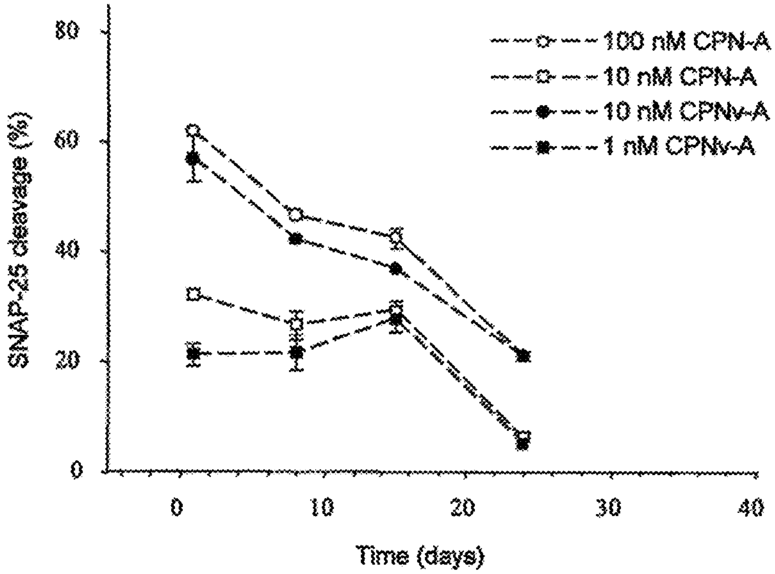

FIG. 16—Cleavage of SNAP-25 Over Extended Time Periods after Exposure of DRG to CPNv-A Primary cultures of dorsal root ganglia (DRG) were exposed to varying concentrations of CPNv-A for 24 hours. CPN-A was used as a control. After this initial exposure, extracellular material was removed by washing, and the cells incubated at 37° C. for varying periods of time. At specific time points, cellular proteins were separated by SDS-PAGE, Western blotted, and probed with anti-SNAP-25 to facilitate an assessment of SNAP-25 cleavage. The percentage of cleaved SNAP-25 was calculated by densitometric analysis.

Figure 17:
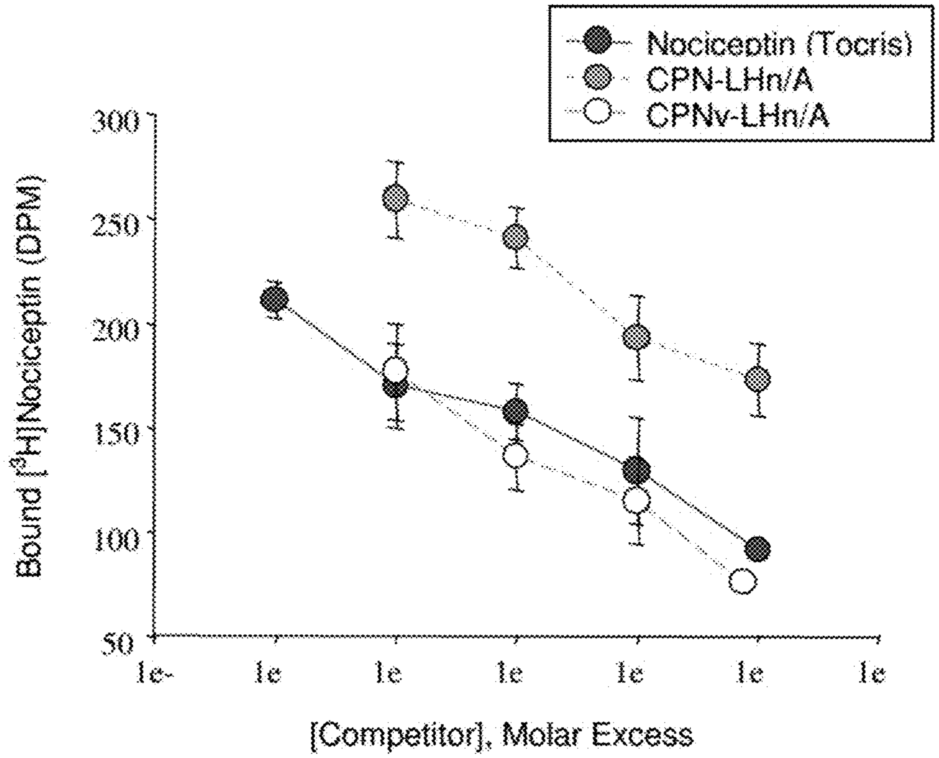

FIG. 17—CPNv-A Fusion-Mediated Displacement of [3H]-Nociceptin Binding

The ability of nociceptin fusions to bind to the $ORL_1$ receptor was assessed using a simple competition-based assay. Primary cultures of dorsal root ganglia (DRG) were exposed to varying concentrations of test material in the presence of 1 nM [3H]-nociceptin. The reduction in specific binding of the radiolabelled ligand was assessed by scintillation counting, and plotted in comparison to the efficacy of unlabelled ligand (Tocris nociceptin). It is clear that the LC/A-nociceptin variant-$H_N$/A fusion (labelled as CPNv-LHnA) is superior to the LC/A-nociceptin-$H_N$/A fusion (labelled as CPN-LHnA) at interacting with the $ORL_1$ receptor.

Figure 18:
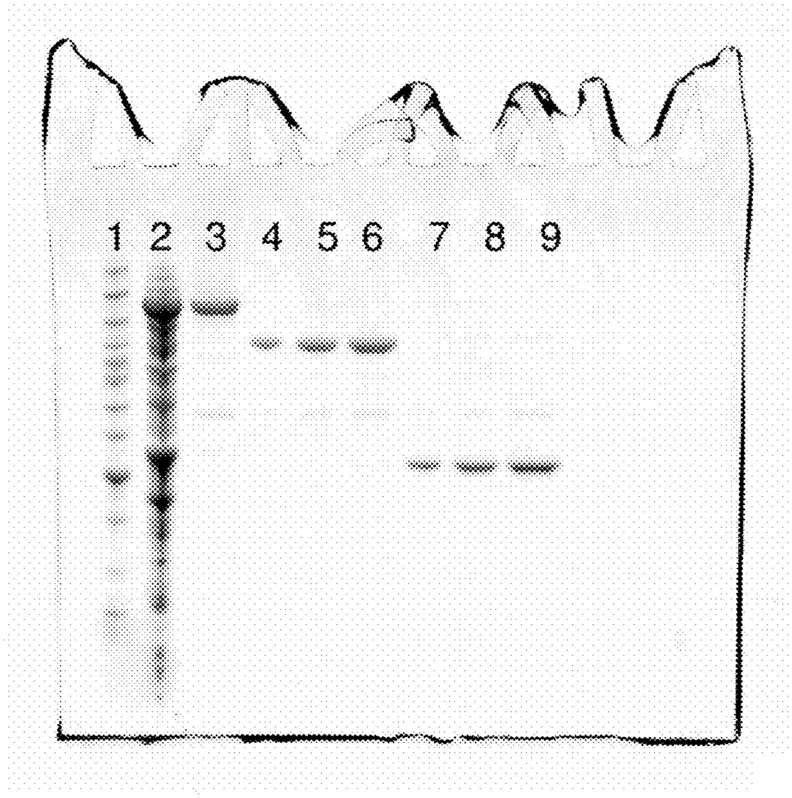

FIG. 18—Expressed/Purified CPNv(Ek)-A Product

Proteins were subjected to SDS-PAGE prior to staining with Coomassie Blue. The electrophoresis profile indicates purification of a disulphide-bonded di-chain species of the expected molecular mass of CPNv(Ek)-A. Lane 1=benchmark molecular mass markers; Lane 2=total *E. coli* protein soluble fraction; Lane 3=purified material following initial capture on $Ni^{2+}$-charged Sepharose; Lane 4=purified final material post activation with enterokinase (5 μl); Lane 5=purified final material post activation with enterokinase (10 μl); Lane 6=purified final material post activation with enterokinase (20 μl); Lane 7=purified final material post activation with enterokinase+DTT (5 μl); Lane 8=purified final material post activation with enterokinase+DTT (10 μl); Lane 9=purified final material post activation with enterokinase+DTT (20 μl).

Figure 19:
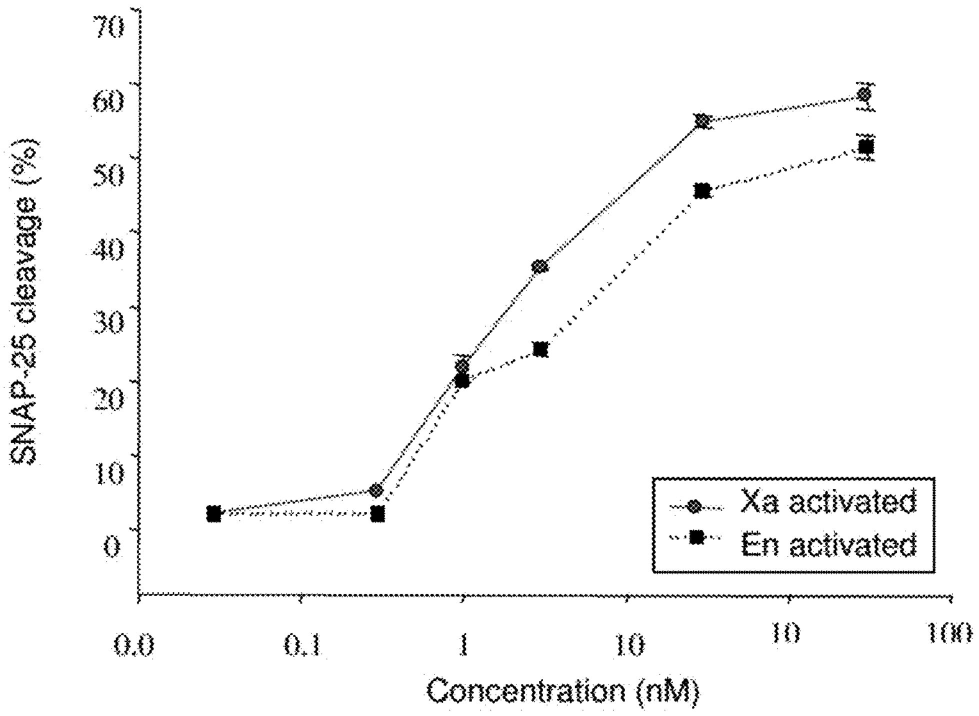

FIG. 19—Cleavage of SNAP-25 by CPNv(Ek)-A

Primary cultures of dorsal root ganglia (DRG) were exposed to varying concentrations of CPNv(Ek)-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. CPNv-A as prepared in Example 26 was used for comparison purposes. The percentage cleavage of SNAP-25 by CPNv(Ek)-A (labelled as En activated) and CPNv-A (labelled as Xa activated) are illustrated.

Figure 20:
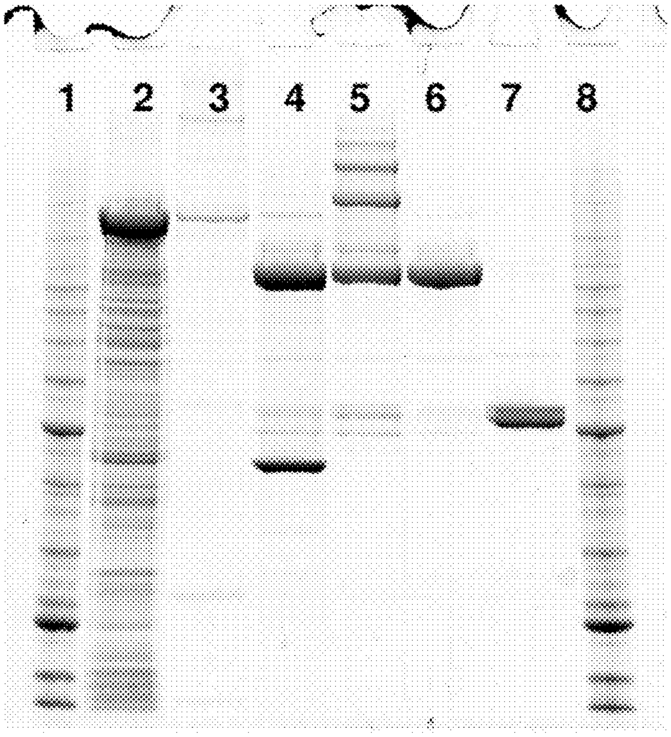

FIG. 20—Expressed/Purified CPNv-C Product

Proteins were subjected to SDS-PAGE prior to staining with Coomassie Blue. The electrophoresis profile indicates purification of a disulphide-bonded di-chain species of the expected molecular mass of CPNv-C. Lane 1=benchmark molecular mass markers; Lane 2=total *E. coli* protein soluble fraction; Lane 3=purified material following initial capture on $Ni^{2+}$-charged Sepharose; Lane 4=Factor Xa treated material prior to final capture on $Ni^{2+}$-charged Sepharose; Lane 5=purified material following second capture on $Ni^{2+}$-charged Sepharose; Lane 6=final purified material; Lane 7=final purified material+DTT; Lane 8=benchmark molecular mass markers.

Figure 21:
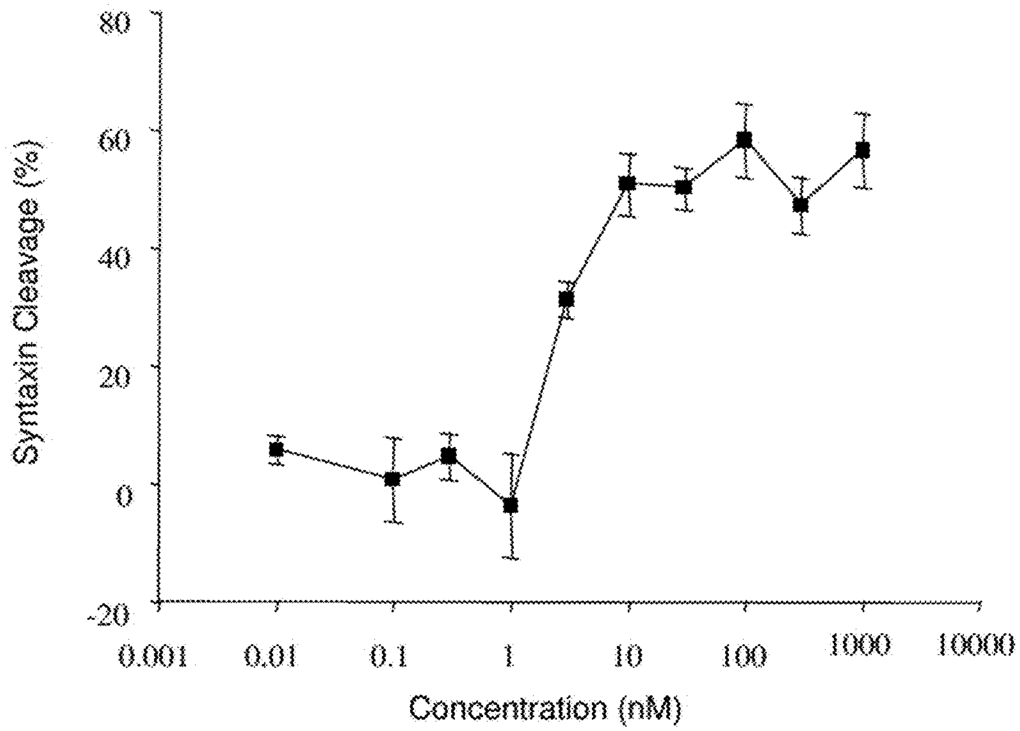

FIG. 21—Cleavage of Syntaxin by CPNv-C

Primary cultures of dorsal root ganglia (DRG) were exposed to varying concentrations of CPNv-C for 24 hours. Cellular proteins were separated by SDS-PAGE, Western blotted, and probed with anti-syntaxin to facilitate an assessment of syntaxin cleavage. The percentage of cleaved syntaxin was calculated by densitometric analysis. The fusion concentration required to achieve 50% maximal syntaxin cleavage is estimated to be 3.13±1.96 nM.

Figure 22:
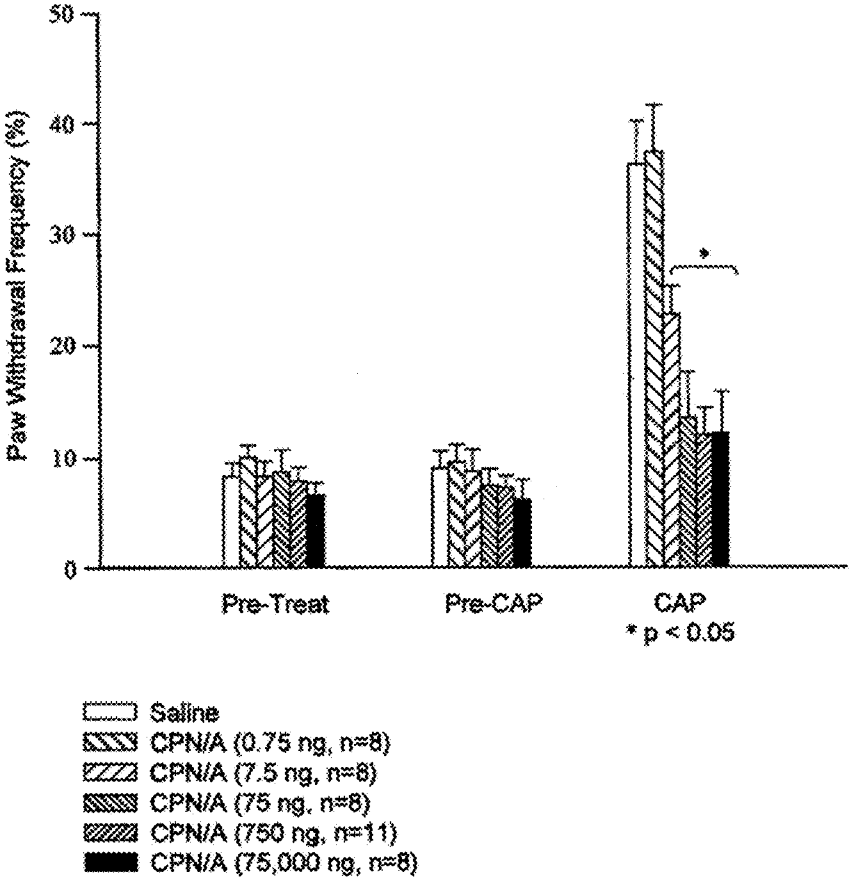

FIG. 22—CPN-A Efficacy in the Acute Capsaicin-Induced Mechanical Allodynia Model The ability of an LC/A-nociceptin-$H_N$/A fusion (CPN/A) to inhibit capsaicin-induced mechanical allodynia was evaluated following subcutaneous intraplantar injection in the rat hind paw. Test animals were evaluated for paw withdrawal frequency (PWF %) in response to a 10 g Von Frey filament stimulus series (10 stimuli×3 trials) prior to recruitment into the study (Pre-Treat); after subcutaneous intraplantar treatment with CPN/A but before capsaicin (Pre-CAP); and following capsaicin challenge post-injection of CPN/A (average of responses at 15' and 30'; CAP). Capsaicin challenge was achieved by injection of 10 μL of a 0.3% solution. Sample dilutions were prepared in 0.5% BSA/saline.

Figure 23:
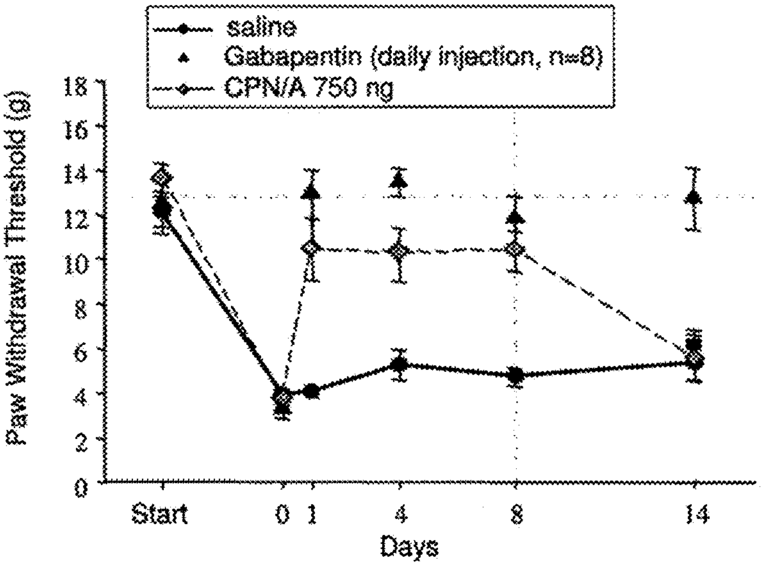

FIG. 23—CPN-A Efficacy in the Streptozotocin (STZ)-Induced Peripheral Diabetic Neuropathy (Neuropathic Pain) Model Male Sprague-Dawley rats (250-300 g) are treated with 65 mg/kg STZ in citrate buffer (I.V.) and blood glucose and lipid are measured weekly to define the readiness of the model. Paw Withdrawal Threshold (PWT) is measured in response to a Von Frey filament stimulus series over a period of time. Allodynia is said to be established when the PWT on two consecutive test dates (separated by 1 week) measures below 6 g on the scale. At this point, rats are randomized to either a saline group (negative efficacy control), gabapentin group (positive efficacy control) or a test group (CPN/A). Test materials (20-25 μl) are injected subcutaneously as a single injection (except gabapentin) and the PWT is measured at 1 day post-treatment and periodically thereafter over a 2 week period. Gabapentin (30 mg/kg i.p. @3 ml/kg injection volume) is injected daily, 2 hours prior to the start of PWT testing.

Figure 24:
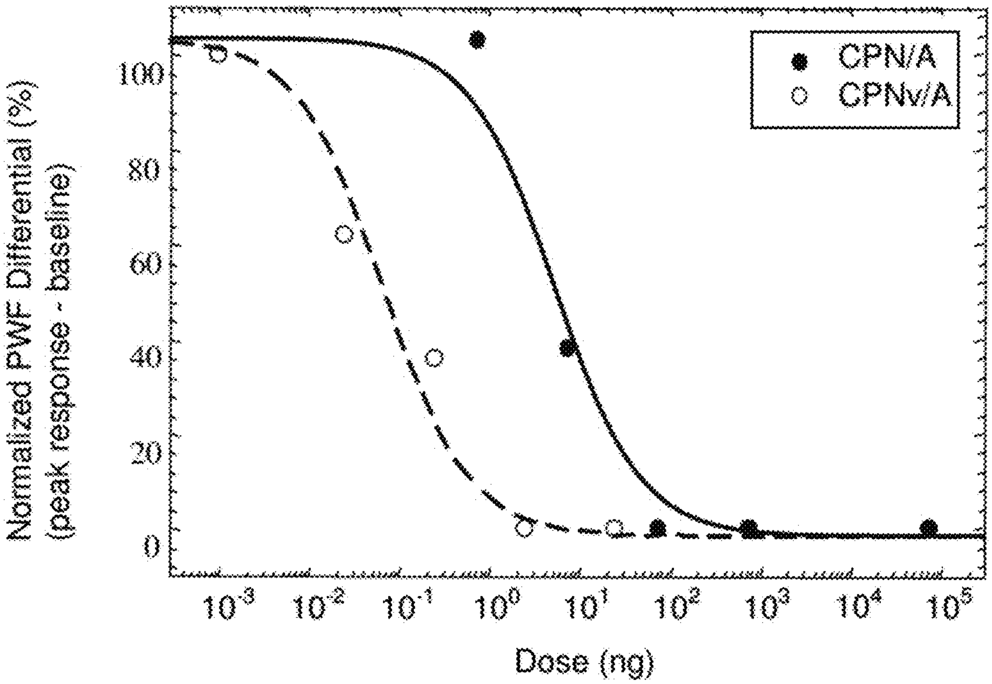

FIG. 24—CPNv-A Efficacy in the Acute Capsaicin-Induced Mechanical Allodynia Model The ability of an LC/A-nociceptin variant-$H_N$/A fusion (CPNv/A) to inhibit capsaicin-induced mechanical allodynia was evaluated following subcutaneous intraplantar injection in the rat hind paw. Test animals were evaluated for paw withdrawal frequency (PWF %) in response to a 10 g Von Frey filament stimulus series (10 stimuli×3 trials) prior to recruitment into the study (Pre-Treat), after subcutaneous intraplantar treatment with CPNv/A but before capsaicin (Pre-CAP), and following capsaicin challenge post-injection of CPNv/A (average of responses at 15' and 30'; CAP). Capsaicin challenge was achieved by injection of 10 μL of a 0.3% solution. Sample dilutions were prepared in 0.5% BSA/saline. These data are expressed as a normalized paw withdrawal frequency differential, in which the difference between the peak response (post-capsaicin) and the baseline response (pre-capsaicin) is expressed as a percentage. With this analysis, it can be seen that CPNv/A is more potent than CPN/A since a lower dose of CPNv/A is required to achieve similar analgesic effect to that seen with CPN/A.

Figure 25:
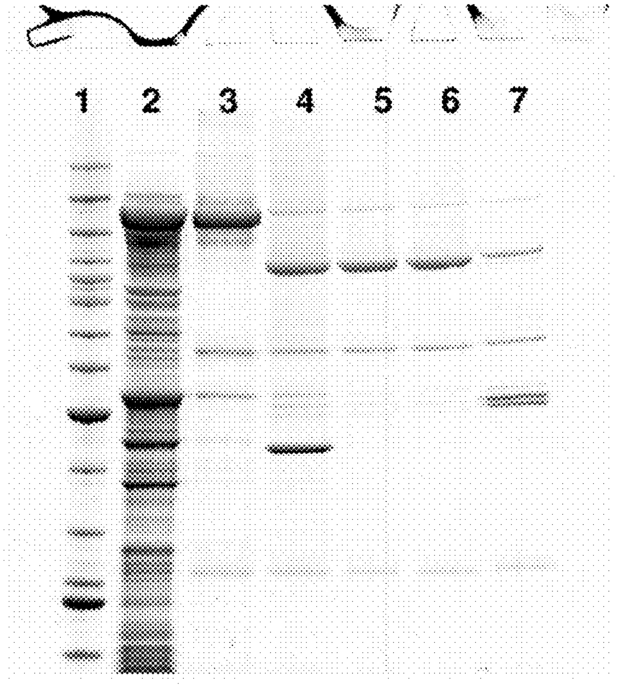

FIG. 25—Expressed/Purified LC/A-CPLE-$H_N$/A Product

Proteins were subjected to SDS-PAGE prior to staining with Coomassie Blue. The electrophoresis profile indicates purification of a disulphide-bonded di-chain species of the expected molecular mass of CPLE-A. Lane 1=benchmark molecular mass markers; Lane 2=total *E. coli* protein soluble fraction; Lane 3=purified material following initial capture on $Ni^{2+}$-charged Sepharose; Lane 4=Factor Xa treated material prior to final capture on $Ni^{2+}$-charged Sepharose; Lane 5=purified material following second capture on $Ni^{2+}$-charged Sepharose; Lane 6=final purified material; Lane 7=final purified material+DTT.

Figure 26:
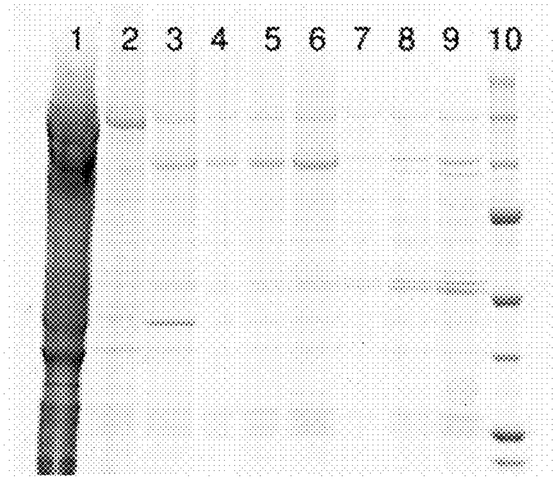

FIG. 26—Expressed/Purified LC/A-CPBE-$H_N$/A Product

Proteins were subjected to SDS-PAGE prior to staining with Coomassie Blue. The electrophoresis profile indicates purification of a disulphide-bonded di-chain species of the expected molecular mass of CPBE-A. Lane 1=total *E. coli* protein soluble fraction; Lane 2=purified material following initial capture on $Ni^{2+}$-charged Sepharose; Lane 3=Factor Xa treated material prior to final capture on $Ni^{2+}$-charged Sepharose; Lane 4=purified final material post activation with Factor Xa (5 μl); Lane 5=purified final material post activation with Factor Xa (10 μl); Lane 6=purified final material post activation with Factor Xa (20 μl); Lane 7=purified final material post activation with Factor Xa+DTT (5 μl); Lane 8=purified final material post activation with Factor Xa+DTT (10 μl); Lane 9=purified final material post activation with Factor Xa+DTT (20 μl); Lane 10=benchmark molecular mass markers.

Figure 27:
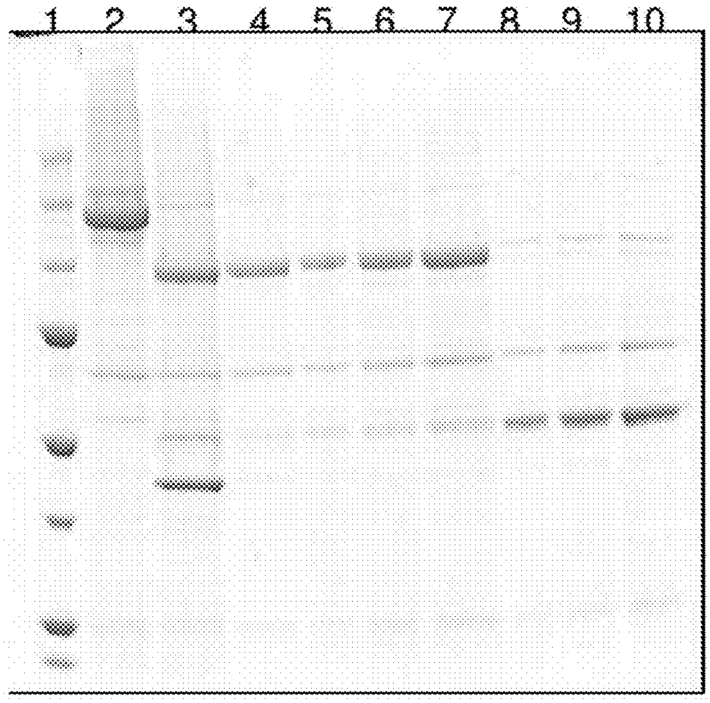

FIG. 27—Expressed/Purified CPOP-A Product

Proteins were subjected to SDS-PAGE prior to staining with Coomassie Blue. The electrophoresis profile indicates purification of a disulphide-bonded di-chain species of the expected molecular mass of CPOP-A. Lane 1=benchmark molecular mass markers; Lane 2=purified material following initial capture on $Ni^{2+}$-charged Sepharose; Lane 3=Factor Xa treated material prior to final capture on $Ni^{2+}$-charged Sepharose; Lane 4=purified material following second capture on $Ni^{2+}$-charged Sepharose; Lane 5=purified final material post activation with Factor Xa (5 μl); Lane 6=purified final material post activation with Factor Xa (10 μl); Lane 7=purified final material post activation with Factor Xa (20 μl); Lane 8=purified final material post activation with Factor Xa+DTT (5 μl); Lane 9=purified final material post activation with Factor Xa+DTT (10 μl); Lane 10=purified final material post activation with Factor Xa+DTT (20 μl).

Figure 28:
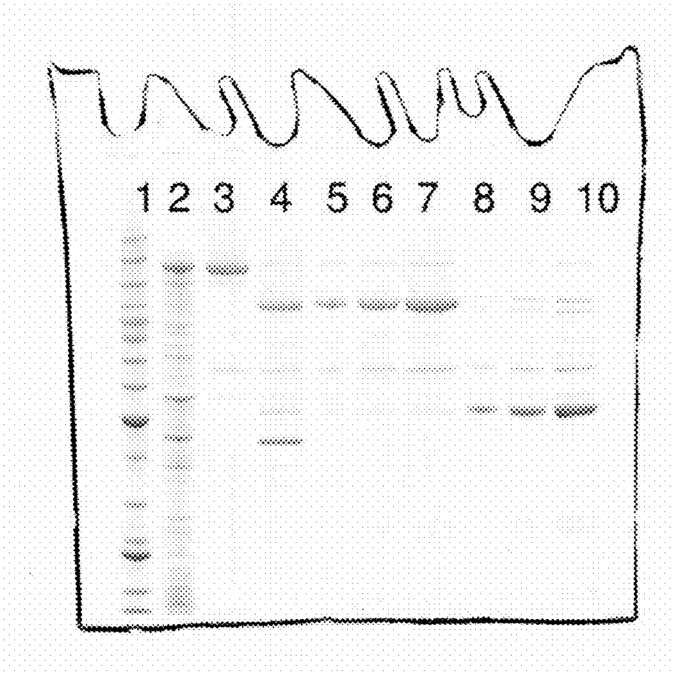

FIG. 28—Expressed/Purified CPOPv-A Product

Proteins were subjected to SDS-PAGE prior to staining with Coomassie Blue. The electrophoresis profile indicates purification of a disulphide-bonded di-chain species of the expected molecular mass of CPOPv-A. Lane 1=benchmark molecular mass markers; Lane 2=total *E. coli* protein soluble fraction; Lane 3=purified material following initial capture on $Ni^{2+}$-charged Sepharose; Lane 4=Factor Xa treated material prior to final capture on $Ni^{2+}$-charged Sepharose; Lane 5=purified final material post activation with Factor Xa (5 μl); Lane 6=purified final material post activation with Factor Xa (10 μl); Lane 7=purified final material post activation with Factor Xa (20 μl); Lane 8=purified final material post activation with Factor Xa+DTT (5 μl); Lane 9=purified final material post activation with Factor Xa+DTT (10 μl); Lane 10=purified final material post activation with Factor Xa+DTT (20 μl).

Figure 29:
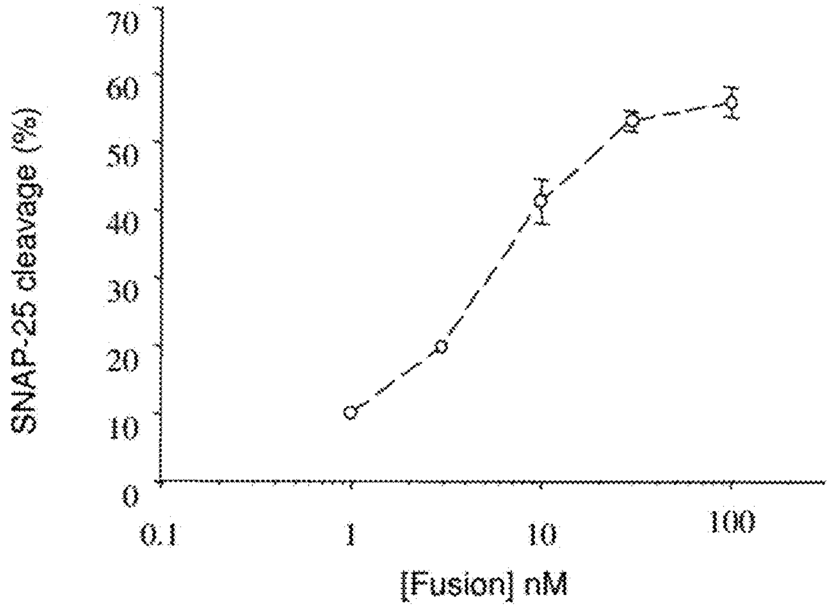

FIG. 29—In Vitro SNAP-25 Cleavage in a DRG Cell Model

Primary cultures of dorsal root ganglia (DRG) were exposed to varying concentrations of CPOPv-A for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis.

Figure 30:
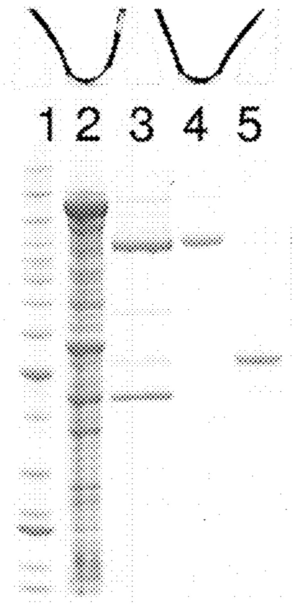

FIG. 30—Expressed/Purified CPNv-A-FXa-HT (Removable His-Tag)

Proteins were subjected to SDS-PAGE prior to staining with Coomassie Blue. The electrophoresis profile indicates purification of a disulphide-bonded di-chain species of the expected molecular mass of CPNv-A-FXa-HT. Lane 1=benchmark molecular mass markers; Lane 2=total *E. coli* protein soluble fraction; Lane 3=Factor Xa treated material prior to final capture on $Ni^{2+}$-charged Sepharose; Lane 4=purified final material post activation with Factor Xa; Lane 5=purified final material post activation with Factor Xa+DTT.

Figure 31:
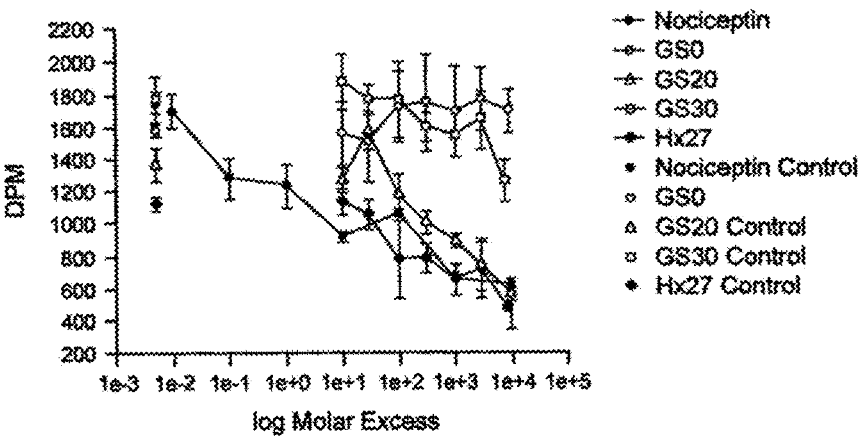
Figure 31:
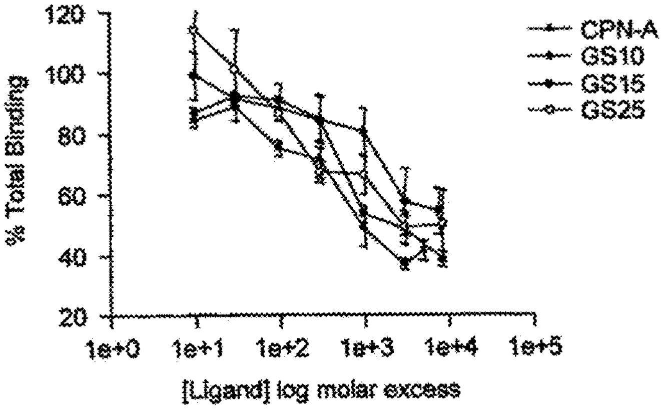

FIG. 31—In Vitro Efficacy of LC/A-Nociceptin-$H_N$/A Fusion Proteins with Variable Spacer Length, as Assessed by Ligand Competition Assay The ability of LC/A-nociceptin-$H_N$/A fusions of variable spacer length to bind to the $ORL_1$ receptor was assessed using a simple competition-based assay. Primary cultures of dorsal root ganglia (DRG) were exposed to varying concentrations of test material in the presence of 1 nM [3H]-nociceptin. The reduction in specific binding of the radiolabelled ligand was assessed by scintillation counting, and plotted in comparison to the efficacy of unlabelled ligand (Tocris nociceptin). The upper panel illustrates the displacement characteristics of the GS0, GS20, GS30 and Hx27 spacers, whilst the lower panel illustrates the displacement achieved by the GS10, GS15 and GS25 spaced fusion proteins. It is concluded that the GS0 and GS30 spacers are ineffective, and the GS10 is poorly effective, at displacing nociceptin from the ORL1 receptor.

Figure 32:
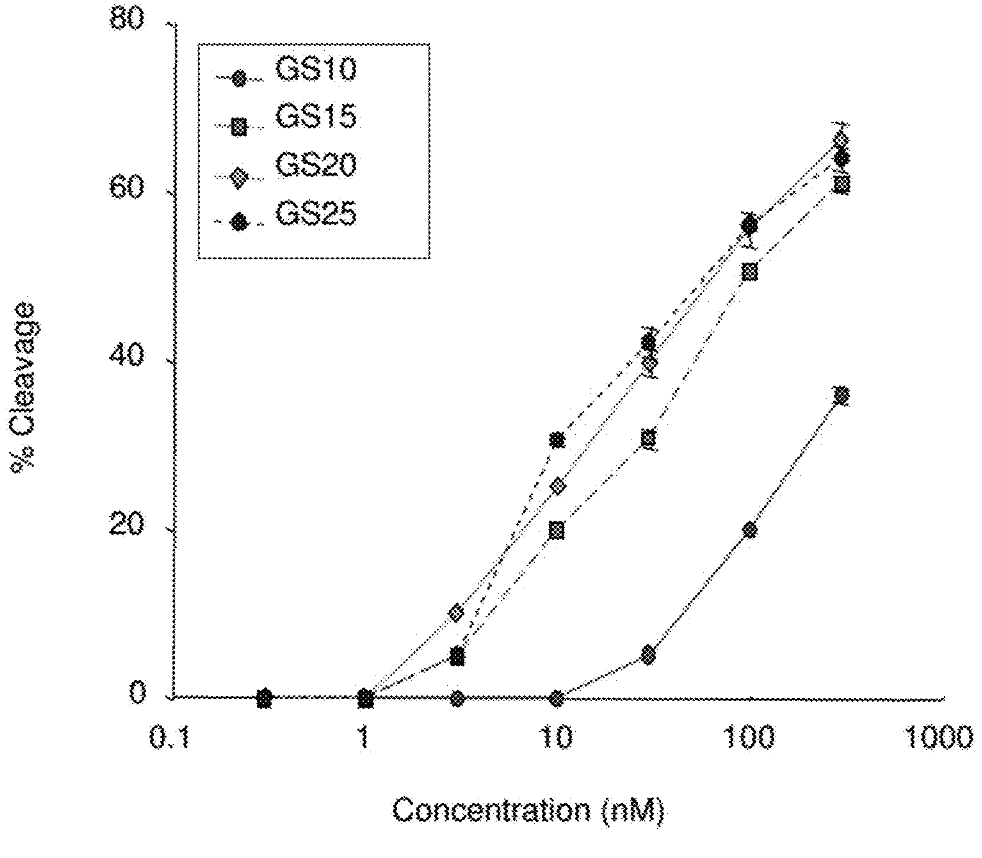

FIG. 32—In Vitro Efficacy of LC/A-Nociceptin-$H_N$/A Fusion Proteins with Variable Spacer Length, as Assessed by In Vitro SNAP-25 Cleavage Primary cultures of dorsal root ganglia (DRG) were exposed to varying concentrations of CPN-A (of variable spacer length) for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. The poorly effective binding characteristics of the GS10 spaced fusion protein (see FIG. 28) are reflected in the higher concentrations of fusion required to achieve cleavage of intracellular SNAP-25. GS0 and GS30 spaced fusion proteins were completely ineffective (date not shown). GS15, 20 and 25 spaced fusion proteins were similarly effective.

Figure 33:
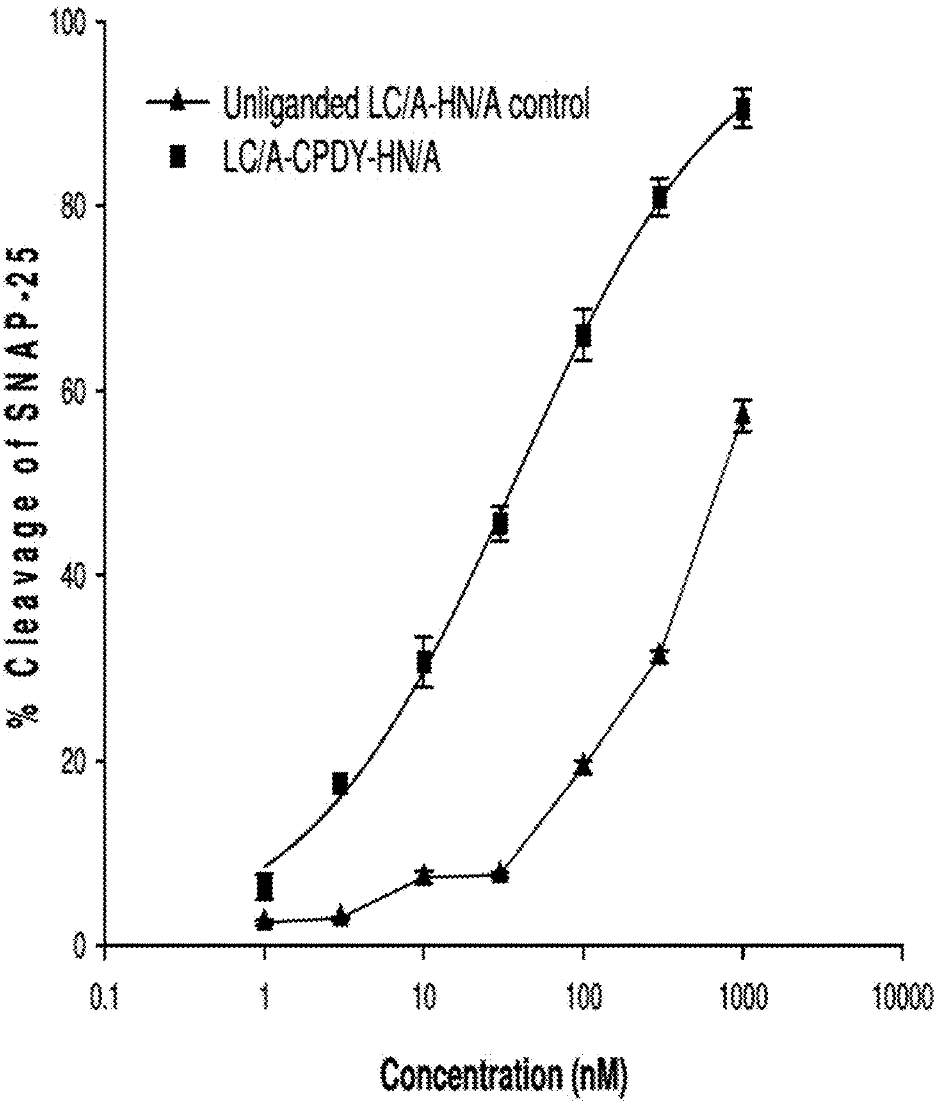

FIG. 33—Cleavage of SNARE Protein by Dynorphin Conjugates in Embryonic Spinal Cord Neurons (eSCNs)

Embryonic spinal cord neurons were exposed to varying concentrations of dynorphin conjugates of the present invention for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that LC/A-dynorphin-$H_N$/A fusion is more potent than an unliganded LC/A-$H_N$/A control molecule. The concentration of LC/A-dynorphin-$H_N$/A fusion required to achieve 50% maximal SNAP-25 cleavage is estimated to be 35.3 nM and the concentration for the LC/A-$H_N$/A control required to achieve 50% maximal SNAP-25 cleavage could not be determined due to it's low potency.

Figure 34:
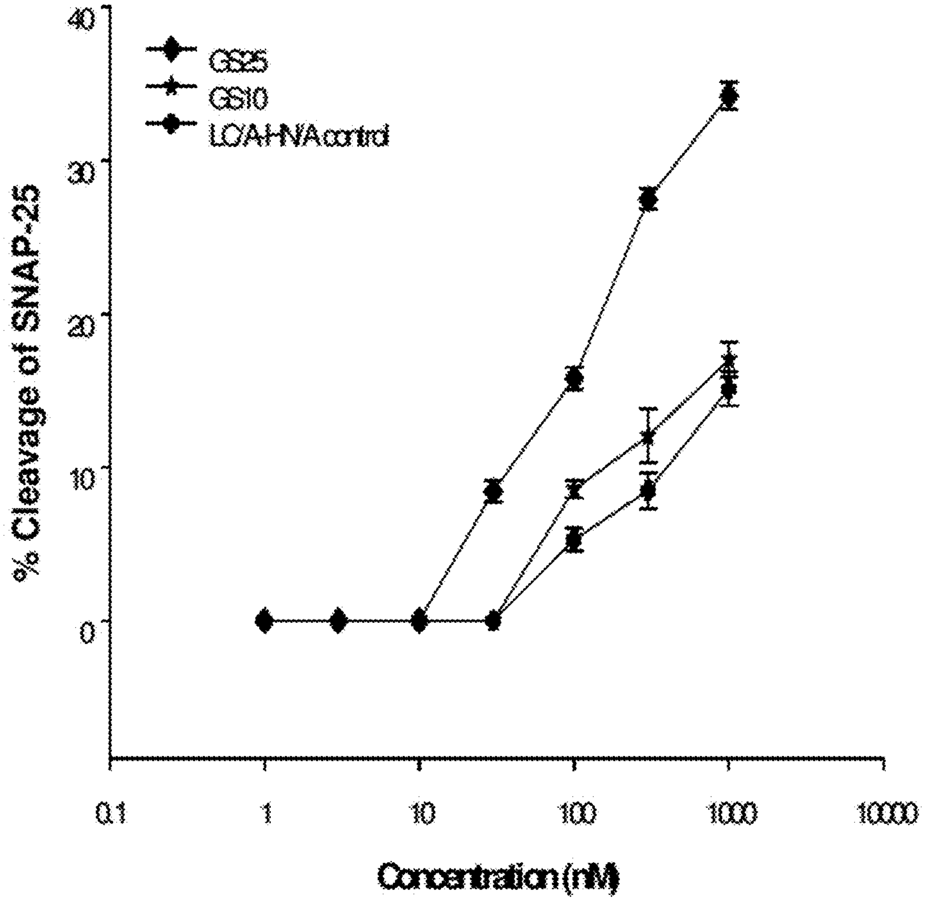

FIG. 34—Cleavage of SNARE Protein by Dynorphin Conjugates in Chinese Hamster Ovary Cells (CHO-K1 Cells) Transfected with OP2 Receptor and SNAP-25

Chinese hamster ovary (CHO) cells were transfected so that they express the OP2 receptor. Said cells were further transfected to express a SNARE protein (SNAP-25). The transfected cells were exposed to varying concentrations of different dynorphin conjugates for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that LC/A-CPDY-$H_N$/A conjugates are more potent than the unliganded LC/A-$H_N$/A control molecule (labelled as LC/A-$H_N$/A).

Figure 35:
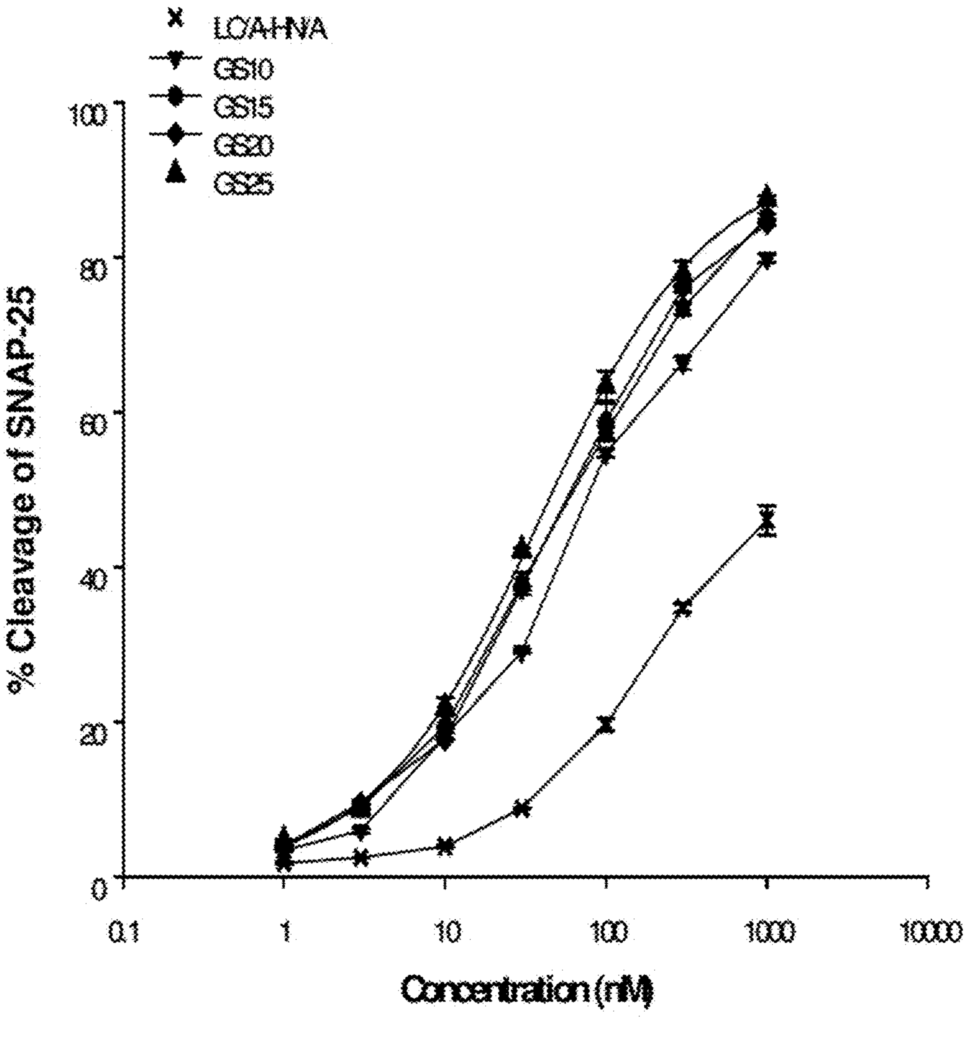

FIG. 35—Cleavage of SNARE Protein by Dynorphin Conjugates in Embryonic Spinal Cord Neurons (eSCNs)

Embryonic spinal cord neurons were exposed to varying concentrations of dynorphin conjugates of the present invention for 24 hours. Cellular proteins were separated by SDS-PAGE, Western blotted, and probed with anti-SNAP-25 to facilitate an assessment of SNAP-25 cleavage. The percentage of cleaved SNAP-25 was calculated by densitometric analysis. It is clear that LC/A-CPDY-$H_N$/A conjugates are more potent than the unliganded LC/A-$H_N$/A control molecule (labelled as LC/A-$H_N$/A).

Figure 36:
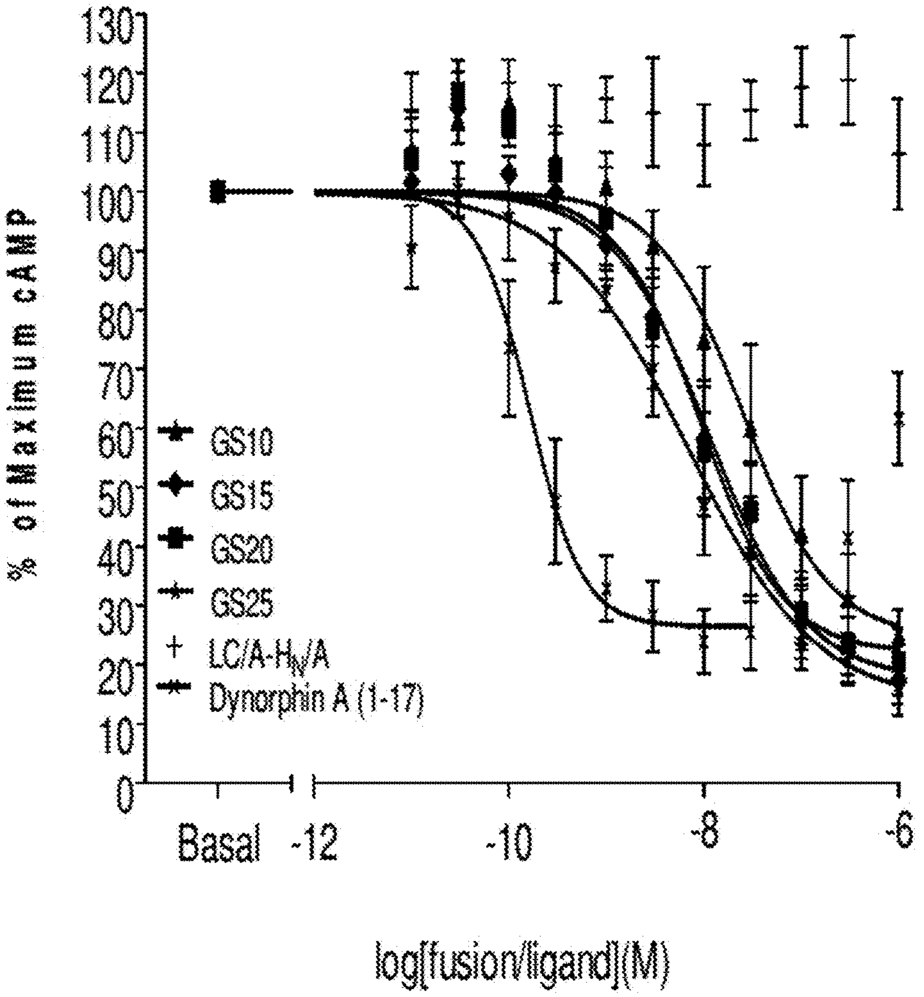

FIG. 36—Kappa Receptor Activation Studies with a Range of Dynorphin Conjugates Chinese hamster ovary (CHO) cells were transfected so that they express the OP2 receptor and SNAP-25. Said cells were used to measure cAMP deletion that occurs when the receptor is activated with a dynorphin ligand, using a FRET-based cAMP kit (LANCE kit from Perkin Elmer). The transfected cells were exposed to varying concentrations of dynorphin conjugates of the present invention for 2 hours. cAMP levels were then detected by addition of a detection mix containing a fluorescently labelled cAMP tracer (Europium-streptavadi/biotin-cAMP) and fluorescently (Alexa) labelled anti-cAMP antibody and incubating at room temperature for 24 hours. Then samples are excited at 320 nM and emitted light measured at 665 nM to determine cAMP levels. It is clear that LC/A-CPDY-$H_N$/A conjugates are more potent than the unliganded LC/A-$H_N$/A control molecule (labelled as LC/A-$H_N$/A).

Figure 37:
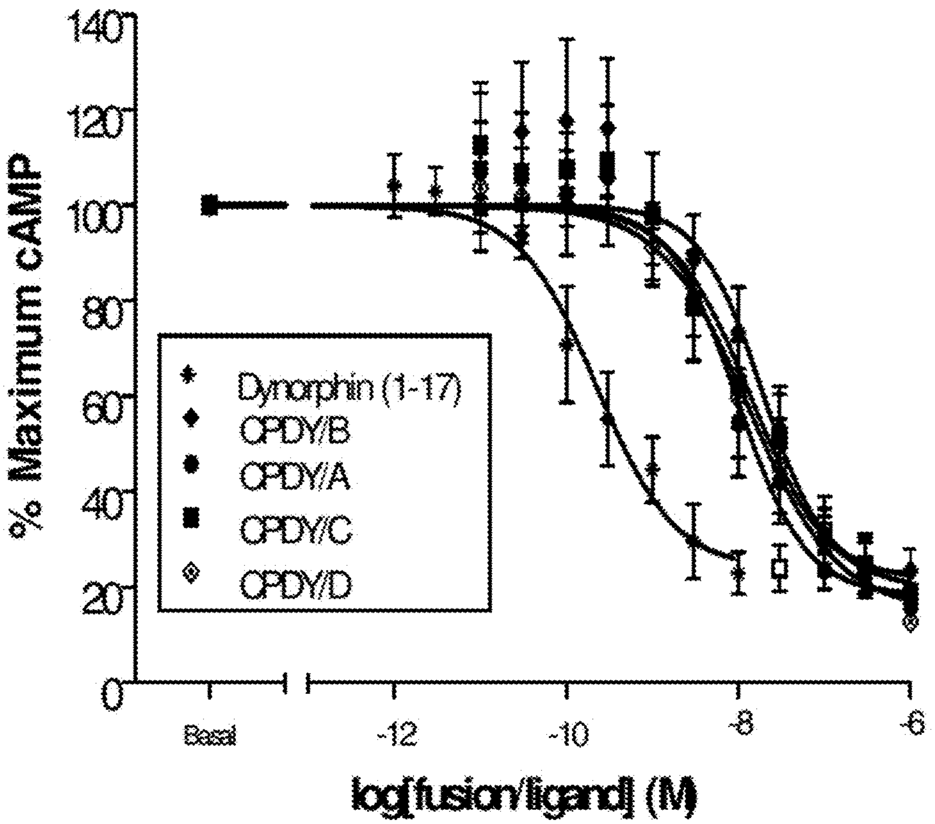

FIG. 37—Kappa Receptor Activation Studies with a Range of Dynorphin Conjugates Chinese hamster ovary (CHO) cells were transfected so that they express the OP2 receptor (purchased from Perkin Elmer). Said cells were transfected so they express SNAP-25 and used to measure cAMP deletion that occurs when the receptor is activated with a dynorphin ligand, using a FRET-based cAMP kit (LANCE kit from Perkin Elmer). The transfected cells were exposed to varying concentrations of dynorphin conjugates of the present invention for 2 hours. cAMP levels were then detected by addition of a detection mix containing a fluorescently labelled cAMP tracer (Europium-streptavadi/biotin-cAMP) and fluorescently (Alexa) labelled anti-cAMP antibody and incubating at room temperature for 24 hours. Then samples are excited at 320 nM and emitted light measured at 665 nM to determine cAMP levels. It is clear from the figure by the reduction in maximum cAMP that the OP2 receptor is activated by LC/A-CPDY-$H_N$/A (labelled as CPDY/A), LC/B-CPDY-$H_N$/B (labelled as CPDY/B), LC/C—CPDY-$H_N$/C (labelled as CPDY/C), and LC/D-CPDY-$H_N$/D (labelled as CPDY/D). The concentration required to achieve 50% reduction in cAMP with LC/A-CPDY-$H_N$/A, LC/B-CPDY-$H_N$/B, LC/C-CPDY-$H_N$/C (labelled as CPDY/, and LC/D-CPDY-$H_N$/D is 10.47 nM, 14.79 nM, 14.79 nM and 23.99 nM, respectively. Dynorphin peptide containing amino acids 1-17 of dynorphin A (labelled as dynorphin (1-17) was more potent than the fusions; 0.15 nm concentration required to achieve 50% reduction of cAMP.

Figure 38:
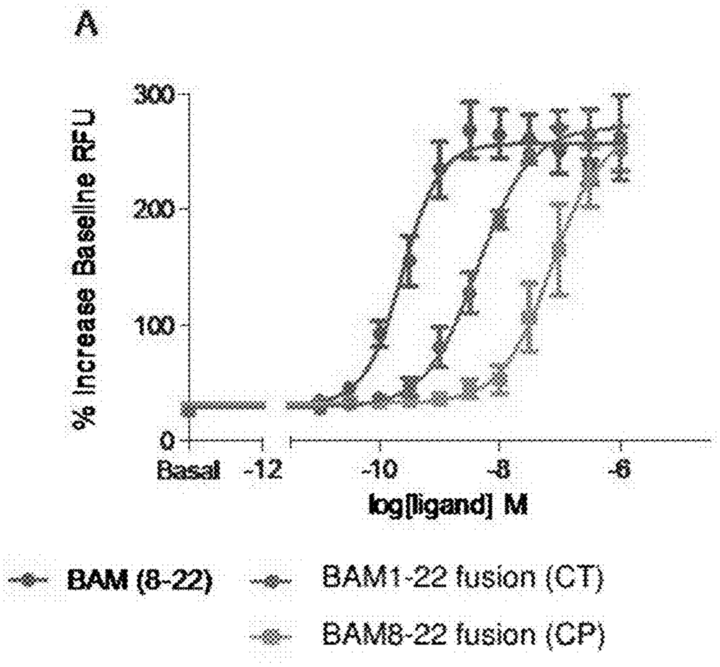

FIG. 38—MrgX1 Receptor Activation Studies with BAM Conjugates

The ability of BAM conjugates of the invention to activate the MrgX1 receptor in CHO cells was evaluated by measurement of the potency ($pEC_{50}$) and intrinsic efficacy (Emax) of ligands at the human MrgX1 receptor. Receptor activation by an agonist to causes $G\alpha_q$ protein activation resulting in $Ca^{2+}$ release from intracellular stores that is mediated by the target enzyme phospholipase Cβ. The transient increase in intracellular $Ca^{2+}$ was measured with a FlexStation3 microplate reader with integrated fluid transfer. CHO cells that express the recombinant human MrgX1 receptor were incubated with the a FLIP R-Calcium-4 masking dye and this $Ca^{2+}$-4 dye formed a complex with $Ca^{2+}$which fluoresces at 525 nm following excitation at 485 nm allowing signal-detection. An inhibitor of cell membrane anion exchanger, probenecid, was included in the assay buffer to prevent outward transport or sequestration of dye molecules. Following incubation with the dye, the cell plate was loaded onto to the FlexStation3 which transfers BAM conjugates (or reference agonist BAMS-22) from a source plate into the microplate wells containing cells. The FlexStation 3 measured the fluorescent-emission from the Calcium-4 dye and readouts were formed as calcium traces displaying the magnitude of calcium flux as a result of MrgX1 receptor activation. The data demonstrated the activation of the MrgX1 receptor by BAM conjugates of the invention.

FIG. 39—BAM Conjugate Efficacy in Capsaicin-Induced Thermal Hyperalgesia Assay The ability of different BAM conjugates of the invention to inhibit capsaicin-induced thermal hyperalgesia was evaluated. Intraplantar pretreatment of conjugates into Sprague-Dawley rats and 24 hours later 0.3% capsaicin was injected and rats were put on 25° C. glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the BAM conjugates of the present invention.

FIG. 40—Conjugate Efficacy in Capsaicin-Induced Thermal Hyperalgesia Assay

The ability of different conjugates of the invention to inhibit capsaicin-induced thermal hyperalgesia was evaluated. Intraplantar pretreatment of conjugates into Sprague-Dawley rats and 24 hours later 0.3% capsaicin was injected and rats were put on 25° C. glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the conjugates of the present is invention.

Figure 41:
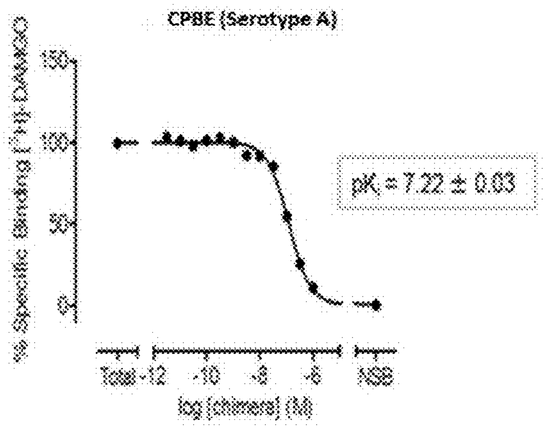
Figure 41:
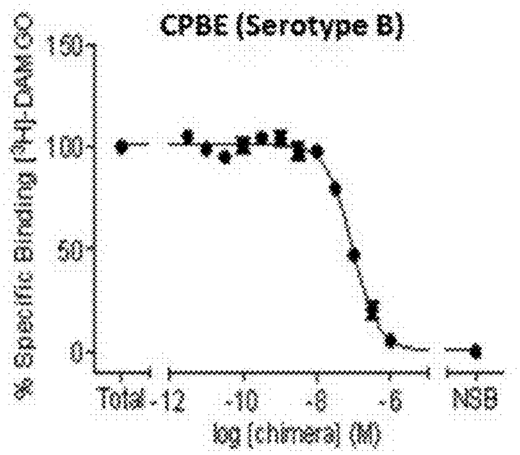
Figure 41:
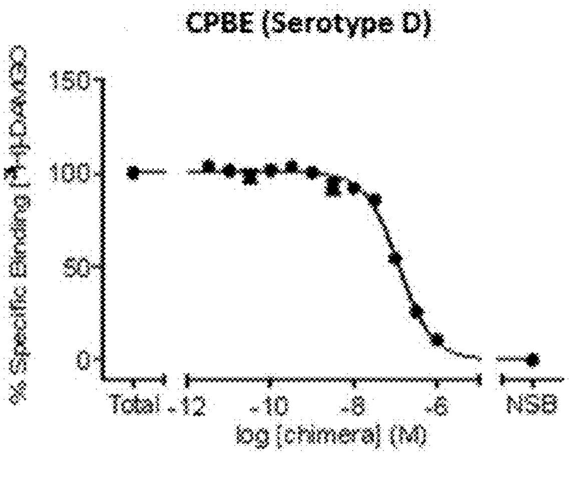

FIG. 41—Mu-Opiod Receptor (OPRM1) Binding Assay with β-Endorphin Conjugates

Chinese hamster ovary (CHO) cells were stably transfected with the human mu-opioid receptors (CHO-K1-OPRM1) and used in a radioligand competition binding assay using [3H]-DAMGO. The data demonstrated that the β-endorphin fusion conjugates of the present invention having different serotype backbones (i.e. A, B and D) demonstrated a concentration-dependent and almost complete inhibition of the specific binding of [3H]-DAMGO to the human mu-opioid receptors.

Figure 42:
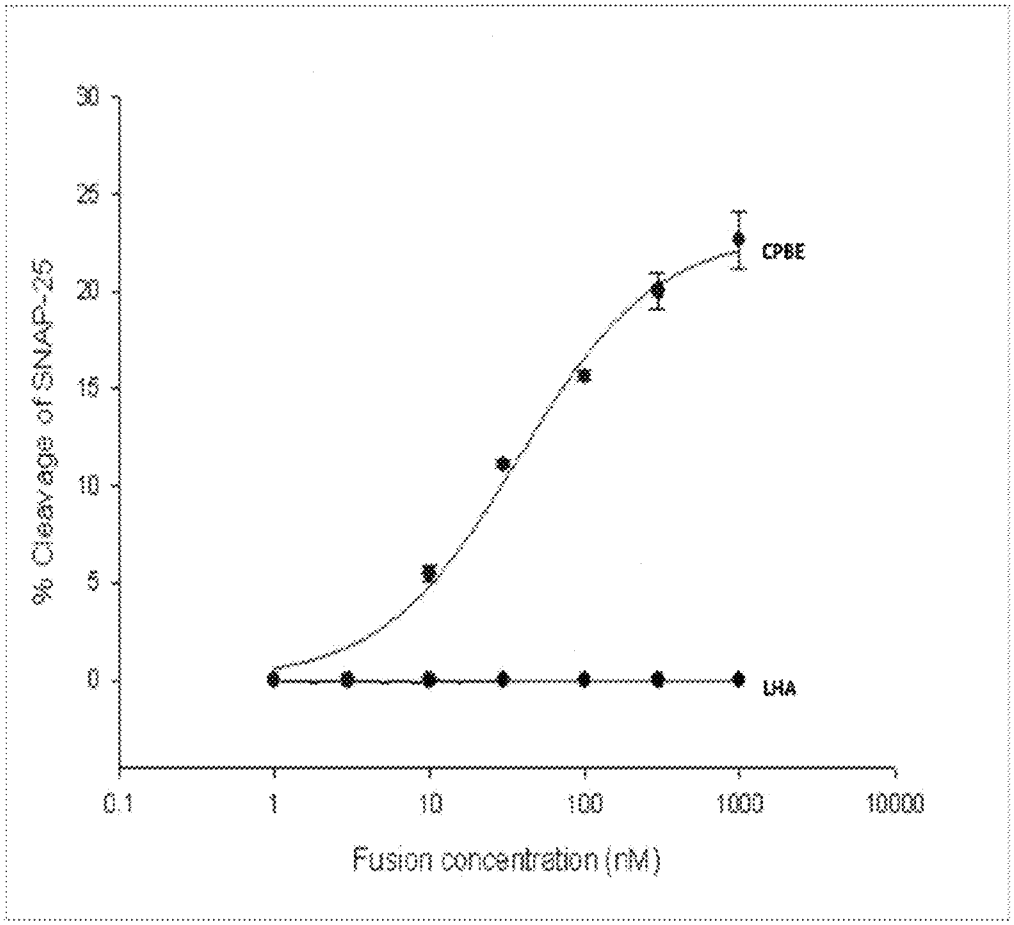

FIG. 42—Cleavage of SNARE Protein by β-Endorphin Conjugates in Human Small Cell Lung Carcinoma Cell Line NCI-H69

A SNAP-25 cleavage assay was developed using the human small cell lung carcinoma cell line NCI-H69 expressing endogenous opiod receptors and the activity of β-endorphin conjugates was assessed. The data demonstrated efficacy of the β-endorphin conjugates in SNARE cleavage. Maximum SNAP-25 cleavage achieved by CPBE fusion protein was 23% ($ED_{50}$ 38 nm).

FIG. 43—β-Endorphin Conjugate Efficacy in Capsaicin-Induced Paw Guarding Assay The nociceptive flexion reflex (also known as paw guarding assay) is a rapid withdrawal movement that constitutes a protective mechanism against possible limb damage. It can be quantified by assessment of electromyography (EMG) response in anesthetized rat as a result of low dose capsaicin, electrical stimulation or the capsaicin-sensitized electrical response. Intraplantar pretreatment (24 hour) of test substance into 300-380 g male Sprague-Dawley rats. Induction of paw guarding in defined method is achieved by 0.006% capsaicin, 10 μl in PBS (7.5% DMSO), injected in 10 seconds. This produces a to robust reflex response from biceps feroris muscle. A reduction/inhibition of the nociceptive flexion reflex indicates that the test substance demonstrates an antinociceptive effect. The paw guarding assay data demonstrated the antinociceptive effect of the β-endorphin conjugates of the present invention.

FIG. 44—β-Endorphin Conjugate Efficacy in Capsaicin-Induced Thermal Hyperalgesia Assay The ability of different β-endorphin conjugates of the invention to inhibit capsaicin-induced thermal hyperalgesia was evaluated. Intraplantar pretreatment of fusion proteins into Sprague-Dawley rats and 24 hours later 0.3% capsaicin was injected and rats were put on 25° C. glass plate (rats contained in acrylic boxes, on 25° C. glass plate). Light beam (adjustable light Intensity) focused on the hind paw. Sensors detected movement of paw, stopping timer. Paw Withdrawal Latency is the time needed to remove the paw from the heat source (Cut-off of 20.48 seconds). A reduction/inhibition of the paw withdrawal latency indicates that the test substance demonstrates an antinociceptive effect. The data demonstrated the antinociceptive effect of the β-endorphin conjugates of the present invention.

Figure 45:
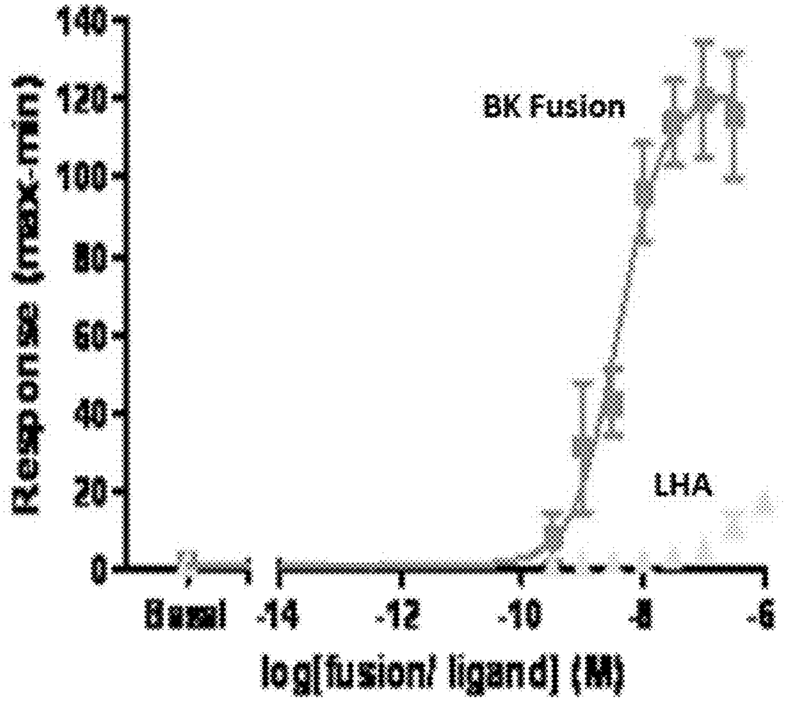

FIG. 45—$B_2$ Receptor Activation Studies with Bradykinin Conjugates

Chinese hamster ovary (CHO) cells were stably transfected with the $B_2$ receptor and used in a calcium fluorimetry assay measuring intracellular calcium levels. The assay allowed the measurement of the potency ($pEC_{50}$) and intrinsic efficacy ($E_{max}$) of the bradykinin fusion protein. The data demonstrated that the bradykinin conjugates activated the $B_2$ receptor and produced a dose dependent increase in intracellular calcium.

FIG. 46—Bradykinin Conjugate Efficacy in Capsaicin-Induced Paw Guarding

The paw guarding assay data (conducted as described above for FIG. 43) demonstrated the antinociceptive effect of the bradykinin conjugates of the present invention.

FIG. 47—Bradykinin Conjugate Efficacy in Capsaicin-Induced Thermal Hyperalgesia Assay The thermal hyperalgesia assay data demonstrated (conducted as described above for FIG. 44) the antinociceptive effect of the bradykinin conjugates of the present invention.

Figure 48:
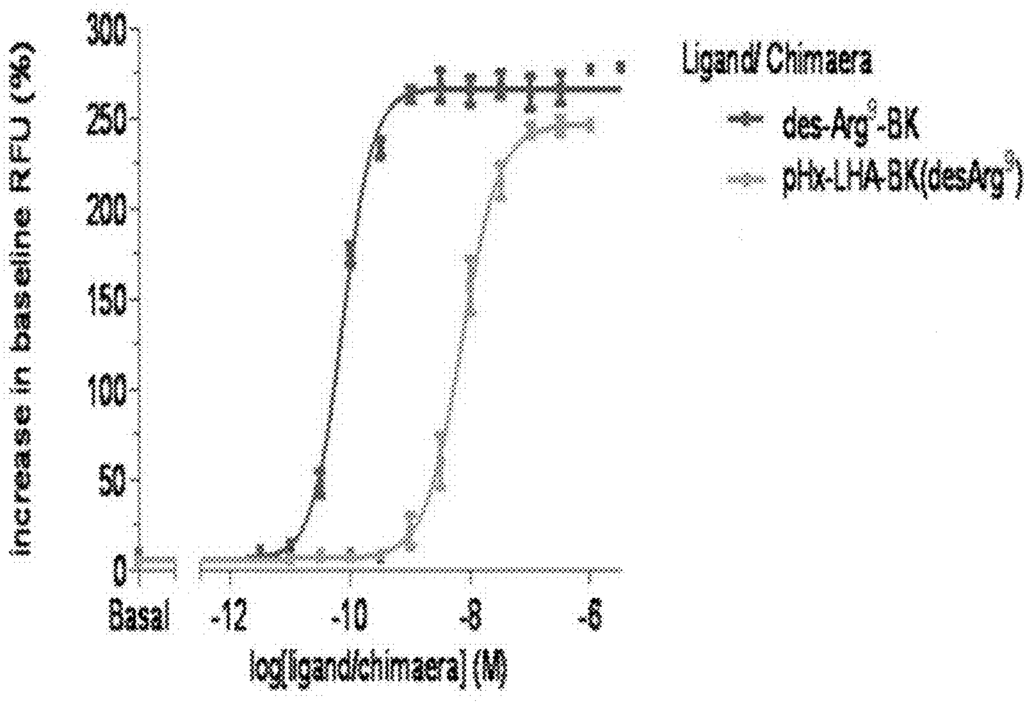

FIG. 48—$B_2$ Receptor Activation Studies with des-$Arg^9$-Bradykinin Conjugates Chinese hamster ovary (CHO) cells were stably transfected with the $B_1$ receptor and used in a calcium fluorimetry assay measuring intracellular calcium levels. The assay allowed the measurement of the potency ($pEC_{50}$) and intrinsic efficacy ($E_{max}$) of conjugates having the des-$Arg^9$-BK ligand. The data demonstrated that the des-$Arg^9$-BK fusion protein activated the $B_1$ receptor and produced a dose dependent increase in intracellular calcium.

DETAILED DESCRIPTION OF THE INVENTION

The use of an "agonist", which would normally stimulate a biological process, particularly exocytosis (for example, an increase in cellular secretion, or an up-regulation in membrane protein expression), is an exciting development in the technical field of re-targeted toxins. Furthermore, it is particularly surprising that an agonist may be employed in a therapeutic composition to achieve a reduction or inhibition of a biological process that the agonist would normally stimulate.

The conjugates of the present invention represent a distinct sub-set of toxin conjugates. In more detail, the conjugates of the present invention comprise TMs that have been selected on the basis of specific properties rather than on the simple basis that they have a corresponding receptor on a pain-sensing target cell of interest.

Conventionally, an agonist has been considered any molecule that can either increase or decrease activities within a cell, namely any molecule that simply causes an alteration of cell activity. For example, the conventional meaning of an agonist would include: a chemical substance capable of combining with a receptor on a cell and initiating a reaction or activity, or a drug that induces an active response by activating receptors, whether the response is an increase or decrease in cellular activity.

However, for the purposes of this invention, an agonist is more specifically defined as a molecule that is capable of stimulating the process of exocytic fusion in a pain-sensing target cell, which process is susceptible to inhibition by a protease (or fragment thereof) capable of cleaving a protein of the exocytic fusion apparatus in said target cell.

Accordingly, the particular agonist definition of the present invention would exclude many molecules that would be conventionally considered as agonists. For example, nerve growth factor (NGF) is an agonist in respect of its ability to promote neuronal differentiation via binding to a TrkA receptor. However, NGF is not an agonist when assessed by the above criteria because it is not a principal inducer of exocytic fusion. In addition, the process that NGF stimulates (i.e. cell differentiation) is not susceptible to inhibition by the protease activity of a non-cytotoxic toxin molecule.

In use, an agonist-containing conjugate of the present invention does not deactivate an agonist receptor on a pain-sensing target cell, but rather the protease activity of the conjugate serves to negate the agonist-mediated response.

Furthermore, once delivered to the cytosol of the pain-sensing target cell, the protease component of a conjugate of the present invention inhibits or blocks the action of all subsequent agonists capable of causing the same effect (i.e. increased exocytic fusion) in the same target cell. This is advantageous and means that the conjugates of the present invention have application in situations where multiple agonists may be responsible for causing the sensation of pain. Thus, when designing a conjugate of the present invention, the TM that is selected for delivery need not necessarily be the principal agonist involved in causing the sensation of pain.

Agonist-mediated delivery according to the present invention provides the following significant advantage over previous non-cytotoxic protease-containing therapeutics: use of an agonist may confer preferential binding and/or internalisation properties on the conjugate. This, in turn, may result in more efficient delivery of the protease component to a pain-sensing target cell.

In addition, use of an agonist as a TM is self-limiting with respect to side-effects. In more detail, binding of an agonist to a pain-sensing target cell increases exocytic fusion, which may exacerbate the sensation of pain. However, the exocytic process that is stimulated by agonist binding is subsequently reduced or inhibited by the protease component of the conjugate.

In preferred embodiments of the invention, the TM is an agonist of the $ORL_1$ receptor. The $ORL_1$ receptor is present on pain-sensing cells in the body.

The $ORL_1$ receptor is a member of the G-protein-coupled class of receptors, and has a seven transmembrane domain structure. The properties of the $ORL_1$ receptor are discussed in detail in Mogil & Pasternak (2001), *Pharmacological Reviews*, Vol. 53, No. 3, pages 381-415.

Throughout this specification, reference to the "$ORL_1$ receptor" embraces all members of the $ORL_1$ receptor family. Members of the $ORL_1$ receptor family typically have a seven transmembrane domain structure, and are coupled to G-proteins of the $G_i$ and $G_0$ families. A method for determining the G-protein-stimulating activity of ligands of the $ORL_1$ receptor is given in Example 17. A method for measuring reduction in cellular cAMP levels following $ORL_1$ activation is given in Example 16. A further characteristic of members of the $ORL_1$ receptor family is that they are typically able to bind nociceptin (the natural ligand of $ORL_1$). As an example, all alternative splice variants of the $ORL_1$ receptor, are members of the $ORL_1$ receptor family.

The conjugates of the present invention generally demonstrate a reduced binding affinity (in the region of up to 100-fold) for nociceptive sensory afferent target cells when compared with the corresponding 'free' TM. However, despite this observation, the conjugates of the present invention surprisingly demonstrate good efficacy. This can be attributed to two principal features. First, the non-cytotoxic protease component is catalytic—thus, the therapeutic effect of a few such molecules is rapidly amplified. Secondly, the receptors present on the nociceptive sensory afferents need only act as a gateway for entry of the therapeutic, and need not necessarily be stimulated to a level required in order to achieve a ligand-receptor mediated pharmacological response. Accordingly, the conjugates of the present invention may be administered at a dosage that is much lower that would be employed for other types of analgesic molecules such as NSAIDS, morphine, and gabapentin. The latter molecules are typically administered at high microgram to milligram (even up to hundreds of milligram) quantities, whereas the conjugates of the present invention may be administered at much lower dosages, typically at least 10-fold lower, and more typically at 100-fold lower.

In a particularly preferred embodiment of the invention, the TM of the conjugate is nociceptin—the natural ligand for the $ORL_1$ receptor. Nociceptin targets the $ORL_1$ receptor with high affinity.

Examples of Other Preferred TMs Include:

| Code | Sequence | Ref. | SEQ ID NO: |
|---|---|---|---|
| Nociceptin 1-17 | FGGFTGARKSARKLANQ | [1] | 1, 2 |
| Nociceptin 1-11 | FGGFTGARKSA | [1] | 3, 4 |
| Nociceptin [Y10]1-11 | FGGFTGARKYA | [1] | 5, 6 |
| Nociceptin [Y11]1-11 | FGGFTGARKSY | [1] | 7, 8 |
| Nociceptin [Y14]1-17 | FGGFTGARKSARKYANQ | [1] | 9, 10 |
| Nociceptin 1-13 | FGGFTGARKSARK | [2] | 11, 12 |
| Nociceptin [R14K15] 1-17 (also known as "variant" nociceptin) | FGGFTGARKSARKRKNQ | [3,4] | 13, 14 |
| Nociceptin 1-13-$NH_2$ | FGGFTGARKSARK-NH2 | [5] | 12 |
| Nociceptin Phe (p-$NO_2$) 1-17 | ($pNO_2$) FGGFTGARKSARKLANQ | [5] | 2 |
| Lofentanil | Non-peptide agonists | [5] | — |
| Etorphine | Non-peptide agonists | [5] | — |
| Peptide agonist | Peptide agonists from combinatorial library approach | [6] | — |

[1] Mogil & Pasternak, 2001, Pharmacol. Rev., 53, 381-415
[2] Maile et al., 2003, Neurosci. Lett., 350, 190-192
[3] Rizzi et al., 2002, J. Pharmacol. Exp. Therap., 300, 57-63
[4] Okada et al., 2000, Biochem. Biophys. Res. Commun., 278, 493-498
[5] Zaveri, 2003, Life Sci., 73, 663-678.
[6] Dooley et al., 1997, J Pharmacol Exp Ther. 283(2), 735-41.

The TM preferably comprises a maximum of 50 amino acid residues, more preferably a to maximum of 40 amino acid residues, particularly preferably a maximum of 30 amino acid residues, and most preferably a maximum of 20 amino acid residues. For example, nociceptin is a 17 amino acid residue peptide.

The above-identified "variant" TM demonstrates particularly good binding affinity (when compared with natural nociceptin) for nociceptive sensory afferents. Generally speaking, a TM-containing conjugate will demonstrate an approximate 100-fold reduction in binding ability vis-à-vis the TM per se. The above-mentioned "variant" TM per se demonstrates an approximate 3- to 10-fold increase in binding ability for a nociceptive sensory afferent vis-à-vis natural nociceptin. Thus, a "variant" TM-containing fusion might be expected to demonstrate an approximate 10-fold reduction in binding ability for a nociceptive sensory afferent vis-à-vis 'free' nociceptin. However, the present inventors have demonstrated that conjugates comprising said "variant" TM demonstrate a binding ability that (most surprisingly) closely mirrors that of 'free' nociceptin—see FIG. 17.

In the context of the present invention, the term opiod or an agonist of the $ORL_1$ receptor (such as nociceptin, or any one of the peptides listed in the table above) embraces molecules having at least 70%, preferably at least 80%, more preferably at least 90%, and most preferably at least 95% amino acid sequence acid identity/homology with said opiod or agonist. The agonist homologues retain the agonist properties of nociceptin at the $ORL_1$ receptor, which may be tested using the methods provided in Example 10. Similarly, an opioid homologue substantially retains the binding function of the opioid with which it shows high amino acid sequence identity/homology.

The invention also encompasses fragments, variants, and derivatives of any one of the TMs described herein. These fragments, variants, and derivatives will substantially retain the properties that are ascribed to said TMs.

In addition to the above-mentioned opioid and non-opioid classes of TMs, a variety of other polypeptides are suitable for targeting the conjugates of the present invention to nociceptive sensory afferents (e.g. to nociceptors). In this regard, particular reference is made to galanin and derivatives of galanin. Galanin receptors are found pre- and post-synaptically in DRGs (Liu & Hokfelt, (2002), Trends Pharm. Sci., 23(10), 468-74), and are enhanced in expression during neuropathic pain states. Proteinase-activated receptors (PARs) are also a preferred group of TMs of the present invention, most particularly PAR-2. It is known that agonists of PAR-2 induce/elicit acute inflammation, in part via a neurogenic mechanism. PAR2 is expressed by primary spinal afferent neurons, and PAR2 agonists stimulate release of substance P(SP) and calcitonin gene-related peptide (CGRP) in peripheral tissues. Another preferred group of TMs of the present invention include bovine adrenal medullary (BAM) peptides, bradykinin and/or substance P.

Another particularly preferred set of TMs of the present invention includes:

| Ligand | Reference |
|---|---|
| Nociceptin | Guerrini, et al., (1997) J. Med. Chem., 40, pp. 1789-1793 |
| β-endorphin | Blanc, et al., (1983) J. Biol. Chem., 258(13), pp. 8277-8284 |
| Endomorphin-1; Endomorphin-2 | Zadina, et al., (1997). Nature, 386, pp. 499-502 |
| Dynorphin | Fields & Basbaum (2002) Chapter 11, In The Textbook of Pain, Wall & Melzack eds. |
| Met-enkephalin | Fields & Basbaum (2002) Chapter 11, In The Textbook of Pain, Wall & Melzack eds. |
| Leu-enkephalin | Fields & Basbaum (2002) Chapter 11, In The Textbook of Pain, Wall & Melzack eds. |
| Galanin | Xu et al., (2000) Neuropeptides, 34 (3&4), 137-147 |
| PAR-2 peptide | Vergnolle et al., (2001) Nat. Med., 7(7), 821-826 |

In a preferred embodiment of the invention, the target for the TM is selected from the group consisting of: Mrg receptors such as MrgX1, opiod receptors such as OPRD1 and/or OPRM1, BDKRB1 and/or BDKRB2, Tachykinin receptors such as TACR1, TACR2 and/or TACR3, Kappa receptor (OPRK1) and/or $ORL_1$ receptor.

In one embodiment, the TM is a molecule that binds (preferably that specifically binds) to one or more of the above-mentioned receptors. For example, the TM is an "agonist" of one or more of the above-mentioned receptors. The term "agonist" in this context is defined as above.

In one embodiment, the TM comprises or consists of a BAM peptide. Full-length BAM is a 22 amino acid peptide, abbreviated herein as BAM1-22 (represented by SEQ ID NO: 120). In one embodiment, the BAM TM of the invention comprises or consists of a 15 amino acid fragment of full-length BAM peptide and is referred to herein as BAMS-22 (represented by SEQ ID NO: 121). In one embodiment, said BAM peptides bind (preferably specifically bind) to Mrg receptors such as MrgX1.

In one embodiment, the TM comprises or consists of a β-endorphin peptide. β-endorphin is a 31 amino acid peptide (represented by SEQ ID NO: 126). In one embodiment, said β-endorphin peptide binds (preferably specifically binds) opioid receptors such as OPRD1 and/or OPRM1.

In one embodiment, the TM comprises or consists of a bradykinin peptide. bradykinin is a 9 amino acid peptide (represented by SEQ ID NO: 129). In one embodiment, said bradykinin peptide binds (preferably specifically binds) bradykinin target receptors BDKRB1 and/or BDKRB2.

In one embodiment, the TM comprises or consists of a des-$Arg^9$-BK ligand (represented by SEQ ID NO: 130). The des-Arg9-Bradykinin ligand differs from bradykinin ligand by the removal of an arginine residue from the C-terminus. In one embodiment, said des-$Arg^9$-BK ligand binds (preferably specifically binds) bradykinin target receptors BDKRB1 and/or BDKRB2.

In one embodiment, the TM comprises or consists of a substance P peptide. Full length substance P is an 11 amino acid peptide (represented by SEQ ID NO: 134). In one embodiment, the TM comprises or consists of a substance P analogue, such as the analogue referred to herein as 'S6' (represented by SEQ ID NO: 135). In one embodiment, said substance P peptide, or analogue thereof binds (preferably specifically binds) to Tachykinin receptors such as TACR1, TACR2 and/or TACR3.

In one embodiment, the TM comprises or consists of a dynorphin peptide. The sequence of dynorphin is represented by SEQ ID NO: 101. In one embodiment, said dynorphin peptide binds (preferably specifically binds) Kappa receptor (OPRK1).

The invention also encompasses fragments, variants, and derivatives and analogues of the above-mentioned TMs. These fragments, variants, and derivatives and analogues substantially retain the properties that are ascribed to said TM. For example, the fragments, variants, and derivatives may retain the ability to bind to their respective receptor(s). By way of example, reference is made to the above-mentioned BAM8-22 fragment of the full length BAM1-22 ™ as well as the substance P analogue S6.

In one embodiment, the TM comprises or consist of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NO: 2, 4, 12, 101, 120, 121, 126, 129, 130, 134 and/or 135.

In one embodiment, the TM comprises or consist of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NO: 120, 121, 126, 129, 130, 134 and/or 135.

In one embodiment, the Targeting Moiety comprises or consists of an amino acid sequence according to SEQ ID NO: 120, 121, 126, 129, 130, 134 and/or 135 or a fragment comprising or consisting of at least 16 (such as at least 5, 6, 7, 8, 9, 10, 11, 12, 13, 14 or 15) contiguous amino acid residues thereof, or a variant amino acid sequence of said SEQ ID NO: 120, 121, 126, 129, 130, 134 and/or 135 or said fragment having a maximum of 6 (such as a maximum of 5, 4, 3, 2 or 1) conservative amino acid substitutions.

The agonist properties of a TM can be confirmed using the methods described in Example 1. These methods are based on previous experiments (see Inoue et al. (1998) Proc. Natl. Acad. Sci., 95, 10949-10953), which confirm that the natural agonist of the $ORL_1$ receptor, nociceptin, causes the induction of substance P release from nociceptive primary afferent neurons. This is supported by the facts that:

- the nociceptin-induced responses are abolished by specific NK1 receptor (the substance P receptor) antagonists; and
- pre-treatment of the cells with capsaicin (which depletes substance P from small diameter primary afferent neurons) attenuates the nociceptin-induced responses.

Similarly, Inoue et al. confirm that an intraplantar injection of botulinum neurotoxin type A abolishes the nociceptin-induced responses. Since it is known that BoNT inhibits the release of substance P from primary afferent neurons (Welch et al., (2000), Toxicon, 38, 245-258), this confirms the link between nociceptin-$ORL_1$ interaction and subsequent release of substance P.

Thus, a TM can be said to have agonist activity at the $ORL_1$ receptor if the TM causes an induction in the release of substance P from a nociceptive sensory afferent neuron (see Example 1).

In another embodiment, opioids represent a preferred group of TMs of the present invention. Within this family of peptides is included enkephalins (met and leu), endomorphins 1 and 2, β-endorphin and dynorphin. Opioid peptides are frequently used in the clinic to modify the activity to nociceptors, and other cells involved in the pain response. As exemplified by the three-step World Health Organisation Analgesic Ladder, opioids have entry points into the pharmacological treatment of chronic cancer and non-cancer pain at all three stages, underlining their importance to the treatment of pain. Reference to opioids embraces fragments, variants and derivatives thereof, which retain the ability to bind to nociceptive sensory afferents.

The protease of the present invention embraces all naturally-occurring non-cytotoxic proteases that are capable of cleaving one or more proteins of the exocytic fusion apparatus in eukaryotic cells.

The protease of the present invention is preferably a bacterial protease.

More preferably, the bacterial protease is selected from the genera *Clostridium* or *Neisseria* (e.g. a clostridial L-chain, or a neisserial IgA protease preferably from *N. gonorrhoeae*).

The present invention also embraces modified non-cytotoxic proteases, which include amino acid sequences that do not occur in nature and/or synthetic amino acid residues, so long as the modified proteases still demonstrate the above-mentioned protease activity.

The protease of the present invention preferably demonstrates a serine or metalloprotease activity (e.g. endopeptidase activity). The protease is preferably specific for a SNARE protein (e.g. SNAP-25, synaptobrevin/VAMP, or syntaxin).

Particular mention is made to the protease domains of neurotoxins, for example the protease domains of bacterial neurotoxins. Thus, the present invention embraces the use of neurotoxin domains, which occur in nature, as well as recombinantly prepared versions of said naturally-occurring neurotoxins.

Exemplary neurotoxins are produced by clostridia, and the term clostridial neurotoxin embraces neurotoxins produced by *C. tetani* (TeNT), and by *C. botulinum* (BoNT) serotypes A-G, as well as the closely related BoNT-like neurotoxins produced by *C. baratii* and *C. butyricum*. The above-mentioned abbreviations are used throughout the present specification. For example, the nomenclature BoNT/A denotes the source of neurotoxin as BoNT (serotype A). Corresponding nomenclature applies to other BoNT serotypes.

The term L-chain fragment means a component of the L-chain of a neurotoxin, which fragment demonstrates a metalloprotease activity and is capable of proteolytically cleaving a vesicle and/or plasma membrane associated protein involved in cellular exocytosis.

A Translocation Domain is a molecule that enables translocation of a protease (or fragment thereof) into a pain-sensing target cell such that a functional expression of protease activity occurs within the cytosol of the target cell. Whether any molecule (e.g. a protein or peptide) possesses the requisite translocation function of the present invention may be confirmed by any one of a number of conventional assays.

For example, Shone C. (1987) describes an in vitro assay employing liposomes, which are challenged with a test molecule. Presence of the requisite translocation function is confirmed by release from the liposomes of $K^+$ and/or labelled NAD, which may be readily monitored (see Shone C. (1987) Eur. J. Biochem; vol. 167(1): pp. 175-180).

A further example is provided by Blaustein R. (1987), which describes a simple in vitro assay employing planar phospholipid bilayer membranes. The membranes are challenged with a test molecule and the requisite translocation function is confirmed by an increase in conductance across said membranes (see Blaustein (1987) FEBS Letts; vol. 226, no. 1: pp. 115-120).

Additional methodology to enable assessment of membrane fusion and thus identification of Translocation Domains suitable for use in the present invention are provided by *Methods in Enzymology*, Vols. 220 and 221, Membrane Fusion Techniques, Parts A and B, Academic Press 1993.

The Translocation Domain is preferably capable of formation of ion-permeable pores in is lipid membranes under conditions of low pH. Preferably, it has been found to use only those portions of the protein molecule capable of pore-formation within the endosomal membrane.

The Translocation Domain may be obtained from a microbial protein source, in particular from a bacterial or viral protein source. Hence, in one embodiment, the Translocation Domain is a translocating domain of an enzyme, such as a bacterial toxin or viral protein.

It is well documented that certain domains of bacterial toxin molecules are capable of forming such pores. It is also known that certain translocation domains of virally expressed membrane fusion proteins are capable of forming such pores. Such domains may be employed in the present invention.

The Translocation Domain may be of a clostridial origin, namely the $H_N$ domain (or a functional component thereof).

$H_N$ means a portion or fragment of the H-chain of a clostridial neurotoxin approximately equivalent to the amino-terminal half of the H-chain, or the domain corresponding to that fragment in the intact H-chain. Examples of suitable clostridial Translocation Domains include:

Botulinum type A neurotoxin—amino acid residues (449-871)

Botulinum type B neurotoxin—amino acid residues (441-858)

Botulinum type C neurotoxin—amino acid residues (442-866)

Botulinum type D neurotoxin—amino acid residues (446-862)

Botulinum type E neurotoxin—amino acid residues (423-845)

Botulinum type F neurotoxin—amino acid residues (440-864)

Botulinum type G neurotoxin—amino acid residues (442-863)

Tetanus neurotoxin—amino acid residues (458-879)

For further details on the genetic basis of toxin production in *Clostridium botulinum* and *C. tetani*, we refer to Henderson et al. (1997) in *The Clostridia: Molecular Biology and Pathogenesis*, Academic press.

The term $H_N$ embraces naturally-occurring neurotoxin $H_N$ portions, and modified $H_N$ portions having amino acid sequences that do not occur in nature and/or synthetic amino acid residues, so long as the modified $H_N$ portions still demonstrate the above-mentioned translocation function.

Alternatively, the Translocation Domain may be of a non-clostridial origin (see table below). Examples of non-clostridial Translocation Domain origins include, but are not restricted to, the translocation domain of diphtheria toxin [O'Keefe et al., Proc. Natl. Acad. Sci. USA (1992) 89, 6202-6206; Silverman et al., J. Biol. Chem. (1993) 269, 22524-22532; and London, E. (1992) *Biochem. Biophys. Acta.,* 1112, pp. 25-51], the translocation domain of *Pseudomonas* exotoxin type A [Prior et al. Biochemistry (1992) 31, 3555-3559], the translocation domains of anthrax toxin [Blanke et al. Proc. Natl. Acad. Sci. USA (1996) 93, 8437-8442], a variety of fusogenic or hydrophobic peptides of translocating function [Plank et al. J. Biol. Chem. (1994) 269, 12918-12924; and Wagner et al (1992) PNAS, 89, pp. 7934-7938], and amphiphilic peptides [Murata et al (1992) *Biochem.,* 31, pp. 1986-1992]. The Translocation Domain may mirror the Translocation Domain present in a naturally-occurring protein, or may include amino acid variations so long as the variations do not destroy the translocating ability of the Translocation Domain.

Particular examples of viral Translocation Domains suitable for use in the present invention include certain translocating domains of virally expressed membrane fusion proteins. For example, Wagner et al. (1992) and Murata et al. (1992) describe the translocation (i.e. membrane fusion and vesiculation) function of a number of fusogenic and amphiphilic peptides derived from the N-terminal region of influenza virus haemagglutinin. Other virally expressed membrane fusion proteins known to have the desired translocating activity are a translocating domain of a fusogenic peptide of Semliki Forest Virus (SFV), a translocating domain of vesicular stomatitis virus (VSV) to glycoprotein G, a translocating domain of SER virus F protein and a translocating domain of Foamy virus envelope glycoprotein. Virally encoded "spike proteins" have particular application in the context of the present invention, for example, the E1 protein of SFV and the G protein of VSV.

Use of the Translocation Domains (listed below) includes use of sequence variants thereof. A variant may comprise one or more conservative nucleic acid substitutions and/or nucleic acid deletions or insertions, with the proviso that the variant possesses the requisite translocating function. A variant may also comprise one or more amino acid substitutions and/or amino acid deletions or insertions, so long as the variant possesses the requisite translocating function.

| Translocation Domain source | Amino acid residues | References |
|---|---|---|
| Diphtheria toxin | 194-380 | Silverman et al., 1994, J. Biol. Chem. 269, 22524-22532<br>London E., 1992, Biochem. Biophys. Acta., 1113, 25-51 |
| Domain II of pseudomonas exotoxin | 405-613 | Prior et al., 1992, Biochemistry 31, 3555-3559<br>Kihara & Pastan, 1994, Bioconj Chem. 5, 532-538 |
| Influenza virus haemagglutinin | GLFGAIAGFIENGWE GMIDGWYG (SEQ ID NO: 170), and Variants thereof | Plank et al., 1994, J. Biol. Chem. 269, 12918-12924<br>Wagner et al., 1992, PNAS, 89, 7934-7938<br>Murata et al., 1992, Biochemistry 31, 1986-1992 |
| Semliki Forest virus fusogenic protein | Translocation domain | Kielian et al., 1996, J Cell Biol. 134(4), 863-872 |
| Vesicular Stomatitis virus glycoprotein G | 118-139 | Yao et al., 2003, Virology 310(2), 319-332 |
| SER virus F protein | Translocation domain | Seth et al., 2003, J Virol 77(11) 6520-6527 |
| Foamy virus envelope glycoprotein | Translocation domain | Picard-Maureau et al., 2003, J Virol. 77(8), 4722-4730 |

Once a potential receptor agonist (e.g. an ORL1 agonist) has been identified, one or more of the following optional steps may be carried out:

(A) confirming that the putative agonist molecule or agonist is capable of being combined with a non-cytotoxic protease (or a fragment thereof) and optionally a Translocation Domain to form a conjugate of the present invention; and/or (B) confirming that said putative agonist molecule or agonist binds to the receptor on the pain-sensing target cell, which receptor is susceptible to receptor-mediated endocytosis; and/or (C) confirming that said putative agonist molecule or agonist is able to deliver a non-cytotoxic protease (or fragment thereof) into the cytosol of a pain-sensing target cell.

The above steps (A)-(C) may be confirmed by routine tests that would be readily available to a skilled person.

For example, step (A) may be performed by a simple chemical conjugation experiment using conventional conjugation reagents and/or linker molecules, followed by native polyacrylamide gel electrophoresis to confirm that a conjugate of the present invention is formed that has the anticipated molecular weight. The conjugate components are typically linked together (optionally via linker molecules) by covalent bonds.

For example, step (B) may be performed by any one of a range of methodologies for assessment of binding of a ligand. Standard text, for example "Receptor-Ligand Interactions. A Practical Approach. Ed. E. C. Hulme, IRL Press, 1992" are available that describe such approaches in detail. In brief, the agonist or putative agonist molecule is labelled (for example, with 125-iodine) and applied to a cell preparation in vitro in the presence of an excess of unlabelled agonist. The purpose of the unlabelled material is to saturate any non-specific binding sites. The agonist is incubated with the cell preparation for sufficient time to achieve equilibrium, and the amount of label bound to the cells assessed by measuring cell associated radioactivity, for example by scintillation or gamma counting.

A further example involves gold-labelling of the agonist (or putative agonist), followed by the use of electron microscopy to monitor the cellular transport progress of the labelled agonist [see the basic methodology described by Rabinowitz S. (1992); J. Cell. Biol. 116 (1): pp. 95-112; and that described by van Deurs (1986); J. Cell. Biol. 102: pp. 37-47].

For example, step (C) may be performed by contacting the conjugate prepared in step (A) with a suitable target cell and assessing cleavage of the substrate. This is performed by extraction of the SNARE proteins, followed by Western blotting of SDS-PAGE-separated samples. Cleavage of substrate is indicative of delivery of the protease into the target cell. In this regard, cleavage may be monitored by disappearance of substrate and/or appearance of cleavage product. A particularly useful antibody that selectively binds to the cleaved substrate product is described in WO95/33850.

Preparation of a conjugate according to the present invention is now discussed.

It is known in the art that the $H_C$ portion of a neurotoxin molecule can be removed from the other portion of the H-chain, known as $H_N$, such that the $H_N$ fragment remains disulphide linked to the L-chain of the neurotoxin providing a fragment known as $LH_N$. Thus, in one embodiment of the present invention the $LH_N$ fragment of a neurotoxin is covalently linked, using linkages which may include one or more spacer regions, to a TM.

In another embodiment of the invention, the $H_C$ domain of a neurotoxin is mutated, blocked or modified, e.g. by chemical modification, to reduce or preferably incapacitate its ability to bind the neurotoxin to receptors at the neuromuscular junction. This modified neurotoxin is then covalently linked, using linkages which may include one or more spacer regions, to a TM.

In another embodiment of the invention, the H-chain of a neurotoxin, in which the $H_C$ domain is mutated, blocked or modified, e.g. by chemical modification, to reduce or preferably incapacitate its native binding ability, is combined with the L-chain of a different neurotoxin, or another protease capable of cleaving a protein of the exocytic fusion apparatus (e.g. IgA protease of *N. gonorrhoeae*). This hybrid, modified neurotoxin is then covalently linked, using linkages which may include one or more spacer regions, to a TM.

In another embodiment of the invention, the $H_N$ domain of a neurotoxin is combined with is the L-chain of a different neurotoxin, or another protease capable of cleaving a protein of the exocytic fusion apparatus (e.g. IgA protease of *N. gonorrhoeae*). This hybrid is then covalently linked, using linkages which may include one or more spacer regions, to a TM.

In another embodiment of the invention, the protease (for example the L-chain component of a neurotoxin) is covalently linked, using linkages that may include one or more spacer regions, to a TM that can also effect the internalisation of the protease into the cytoplasm of the relevant target cell(s).

In another embodiment of the invention, the protease (for example the L-chain component of a neurotoxin) is covalently linked, using linkages which may include one or more spacer regions, to a translocation domain to effect transport of the protease fragment into the cytosol.

In use, the domains of a conjugate according to the present invention are associated with each other. In one embodiment, two or more of the domains may be joined together either directly (e.g. by a covalent linkage), or via a linker molecule.

A variety of different linker/spacer molecules may be employed in any of the fusion proteins of the present invention. Examples of such spacer molecules include those illustrated in FIGS. 31 and 32. Particular mention here is made to GS15, GS20, GS25, and Hx27—see FIGS. 31 and 32.

The present inventors have unexpectedly found that non-cytotoxic protease-TM conjugates (eg. CPNv/A) may demonstrate an improved binding activity for nociceptive sensory afferents when the size of the spacer is selected so that (in use) the TM (preferably the C-terminus thereof) and the translocation domain (preferably the N-terminus thereof) are separated from one another by 40-105 angstroms, preferably by 50-100 angstroms, and more preferably by 50-90 angstroms. In another embodiment, the preferred spacers have an amino acid sequence of 11-29 amino acid residues, preferably 15-27 amino acid residues, and more preferably 20-27 amino acid residues. Suitable spacers may be routinely identified and obtained according to Crasto, C. J. and Feng, J. A. (2000) May, 13 (5), pp. 309-312—see also the website having a URL ending in: fccc./edu/research/labs/feng/limker.html.

Conjugation techniques suitable for use in the present invention have been well documented and are routine for a person skilled in the art.

The methodology involved in coupling two protein molecules (A and B) together is simple, and is achieved through the use of a cross-linking agent (also known as a chemical coupling agent). For example, molecules A and B are separately contacted with a cross-linking agent, which chemically modifies a specific surface group on each of molecules A and B thereby forming derivatised molecules A' and B'. The modified surface group on molecule A' is capable of covalently bonding with the modified surface group on molecule B'. Thus, the coupling reaction is completed by mixing together the two protein molecules A' and B'.

Chemical conjugation is illustrated by reference to the following embodiments, where P=non-cytotoxic protease component, T=translocation component, and TM=targeting moiety.

In one embodiment, a single chain P-T is prepared, which is then conjugated to a TM. In another embodiment, a single chain TM-T (or T-TM) is prepared, which is then conjugated to a P. In a further embodiment, a single chain P-TM (or TM-P) is prepared, which is then conjugated to a T. Another particularly preferred conjugate has the structure P-TM-T (with an optional protease cleavage site between P and TM).

Where the T and P components are prepared as a single chain polypeptide, a protease cleavage site is typically included between said components. Any protease cleavage site may be employed in this regard.

In an alternative embodiment, the three components may be simultaneously or sequentially conjugated together. Thus, the conjugation may be a one- or two-step process, and may include one or more different coupling agents.

In another embodiment of the present invention, the TM is either N- or C-terminally located with respect to the conjugate. In other words, in one embodiment the TM is not located between the non-cytotoxic protease and translocation domain components of the non-cytotoxic protein conjugate.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID NOs: 50, 110, 111, 112, 113, 114, 115, 116, 117, 118, 119, 123, 124, 125, 127, 128, 132, 133, 136, 137, 138, 141, 142, 143, 144, 145, 146, 147, 148, 149, 150, 151, 152, 153, 154, 155, 156, 157, 158, 159, 160, 161, 162, 163, 164, 165, 166, 167, 168, and/or 169.

In one embodiment, the invention provides a non-cytotoxic protein conjugate comprising comprising (or consisting of) an amino acid sequence having at least 80% (such as at least 85, 90, 92, 94, 95, 96, 97, 98, 99 or 100%) sequence identity to the amino acid sequence of SEQ ID NOs: 110, 111, 112, 113, 114, 115, 116, 117, 118, 119, 141, 152, 153, 154, 155, 156, 157, 158, 159, 160, 161, and/or 162.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID NOs: 123, 124, 125, 144, 145 and/or 146.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID Nos: 50, 127, 128, 147, 148, 149 and/or 150.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID NOs: 132, 133 and/or 151.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID NO: 136 and/or 169.

In one embodiment, the invention provides a non-cytotoxic protein conjugate comprising (or consisting of) an amino acid sequence having at least 80% (such as at least 85, 90, 92, 94, 95, 96, 97, 98, 99 or 100%) sequence identity to the amino acid sequence of SEQ ID NOs: 137, 138, 142, 143, 163, 164, 165, 166, 167 and/or 168.

Chemical coupling agents and cross-linking agents have been commercially available for many years.

Example 5 of the present invention describes in detail the use of one such coupling agent, namely SPDP, to chemically couple two protein molecules (nociceptin, and the $LH_N$ of botulinum neurotoxin). The two molecules are separately contacted with SPDP, and then mixed together to allow covalent conjugation.

The conjugate described in Example 6 confirms that another coupling agent, PDPH/EDAC, or Traut's reagent, may be employed as an alternative coupling agent to SPDP.

SPDP and Traut's reagent are popular and well-documented coupling agents in the technical field of protein conjugation chemistry and are presented here simply as two examples of a well known class of compounds that may be employed to covalently link together the Targeting Moiety component and the clostridial neurotoxin component of the conjugate of the present invention. Other suitable agents include SMPB, SMCC (succinimidyl 4-(N-maleimidomethyl)cyclohexan-1-carboxylate), and LC-SPDP.

In more detail, commercially available members of the well-known coupling agents may be used for conjugation purposes to produce a conjugate of the invention. Details of such agents can be found in the following publications:

Hermanson, G. T. (1996), Bioconjugate techniques, Academic Press;

Wong, S. S. (1991), Chemistry of protein conjugation and cross-linking, CRC Press;

Thorpe et al (1987), Cancer Res, 1987, 47, 5924-31. This paper describes the use of SMBT (sodium S-4-succinimidyloxycarbonyl-alpha-methyl benzyl thiosulfate) and SMPT (4-succinimidyloxycarbonyl-alpha-methyl-alpha(2-pyridyldithio)toluene); and Peeters et al (1989), J Immunol Methods. 1989, 120, 133-43. This paper describes the use of 4 coupling reagents, MHS (succinimidyl 6-(N-maleimido)-n-hexanoate), SMCC (succinimidyl 4-(N-maleimidomethyl)-cyclohexane-1-carboxylate), MBS (succinimidyl m-maleimidobenzoate), and SPDP.

The conjugates according to the present invention may also be prepared recombinantly, as detailed in Examples 9 to 12.

In one embodiment, the preparation of a recombinant conjugate involves arrangement of the coding sequences of a selected TM, a selected non-cytotoxic protease component, and a translocation component (in any order) in a single genetic construct. These coding sequences may be arranged in-frame so that subsequent transcription and translation is continuous through both coding sequences and results in a fusion protein. All constructs would have a 5' ATG codon to encode an N-terminal methionine, and a C-terminal translational stop codon.

Thus, the recombinant preparation method results in the generation of a single chain polypeptide. In order to activate this polypeptide, a protease cleavage site is present between the non-cytotoxic protease component and the translocation component. Cleavage of this site generates a di-chain polypeptide in which the protease and to translocation domains are linked together by way of a covalent bond, preferably a disulphide bond. In this regard, any protease cleavage site may be employed.

In the single polypeptide aspect of the present invention, the TM may be N- or C-terminally located with respect to the fusion protein. In other words, in one embodiment is the TM is not located between the non-cytotoxic protease and translocation domain components of the single-chain polypeptide fusion protein.

In another embodiment, the TM is located between the non-cytotoxic protease and translocation domain components of the single-chain polypeptide fusion protein.

In one embodiment, an L-chain of a clostridial neurotoxin or another protease capable of cleaving a protein of the exocytic fusion apparatus (e.g. an IgA protease), or a fragment/variant thereof, may be expressed recombinantly as a fusion protein with a TM, which TM can also effect the internalisation of the L-chain component into the cytoplasm of the relevant target cell(s) responsible for secretion. Alternatively, the fusion protein may further comprise a Translocation Domain. The expressed fusion protein may include one or more spacer regions.

By way of example, the following information is required to produce, recombinantly, an agent of the present invention:

(I) DNA sequence data relating to a selected TM;

(II) DNA sequence data relating to the protease component;

(III) DNA sequence data relating to the translocation domain; and (IV) a protocol to permit construction and expression of the construct comprising (I), (II) and (III).

All of the above basic information (I)-(IV) are either readily available, or are readily determinable by conventional methods. For example, both WO98/07864 and WO99/17806 exemplify recombinant technology suitable for use in the present application.

In addition, methods for the construction and expression of the constructs of the present invention may employ information from the following references and others:

Lorberboum-Galski, H., FitzGerald, D., Chaudhary, V., Adhya, S., Pastan, I. (1988), Cytotoxic activity of an interleukin 2-Pseudomonas exotoxin chimeric protein produced in *Escherichia coli*. Proc. Natl. Acad. Sci. USA, 85(6):1922-6;

Murphy, J. R. (1988), Diphtheria-related peptide hormone gene fusions: a molecular genetic approach to chimeric toxin development. Cancer Treat. Res.; 37:123-40;

Williams, D. P., Parker, K., Bacha, P., Bishai, W., Borowski, M., Genbauffe, F., Strom, T. B., Murphy, J. R. (1987), Diphtheria toxin receptor binding domain substitution with interleukin-2: genetic construction and properties of a diphtheria toxin-related interleukin-2 fusion protein. Protein Eng; 1(6):493-8;

Arora, N., Williamson, L. C., Leppla, S. H., Halpern, J. L. (1994), Cytotoxic effects of a chimeric protein consisting of tetanus toxin light chain and anthrax toxin lethal factor in non-neuronal cells J. Biol. Chem., 269(42): 26165-71;

Brinkmann, U., Reiter, Y., Jung, S. H., Lee, B., Pastan, I. (1993), A recombinant immunotoxin containing a disulphide-stabilized Fv fragment. Proc. Natl. Acad. Sci. USA, 90(16):7538-42; and O'Hare, M., Brown, A. N., Hussain, K., Gebhardt, A., Watson, G., Roberts, L. M., Vitetta, E. S., Thorpe, P. E., Lord, J. M. (1990), Cytotoxicity of a recombinant ricin-A-chain fusion protein containing a proteolytically-cleavable spacer sequence. FEBS Lett October 29; 273 (1-2):200-4.

Suitable clostridial neurotoxin sequence information relating to L- and $LH_N$-chains may be obtained from, for example, Kurazono, H. (1992) J. Biol. Chem., vol. 267, No. 21, pp. 14721-14729; and Popoff, M. R., and Marvaud, J.-C. (1999) *The Comprehensive Sourcebook of Bacterial Protein Toxins*, 2nd edition (ed. Alouf, J. E., and Freer, J. H.), Academic Press, pp. 174-201.

All of the aforementioned publications are hereby incorporated into the present specification by reference thereto.

Similarly, suitable TM sequence data are widely available in the art. Alternatively, any necessary sequence data may be obtained by techniques which are well-known to the skilled person.

For example, DNA encoding the TM component may be cloned from a source organism by screening a cDNA library for the correct coding region (for example by using specific oligonucleotides based on the known sequence information to probe the library), isolating the TM DNA, sequencing this DNA for confirmation purposes, and then placing the isolated DNA in an appropriate expression vector for expression in the chosen host.

As an alternative to isolation of the sequence from a library, the available sequence information may be employed to prepare specific primers for use in PCR, whereby the coding sequence is then amplified directly from the source material and, by suitable use of primers, may be cloned directly into an expression vector.

Another alternative method for isolation of the coding sequence is to use the existing sequence information and synthesise a copy, possibly incorporating alterations, using DNA synthesis technology. For example, DNA sequence data may be generated from existing protein and/or RNA sequence information. Using DNA synthesis technology to do this (and the alternative described above) enables the codon bias of the coding sequence to be modified to be optimal for the chosen expression host. This may give rise to superior expression levels of the fusion protein.

Optimisation of the codon bias for the expression host may be applied to the DNA sequences encoding the TM and clostridial components of the construct. Optimisation of the codon bias is possible by application of the protein sequence into freely available DNA/protein database software, e.g. programs available from Genetics Computer Group, Inc.

Having prepared a conjugate of the invention, it is a matter of routine to confirm that the various domains have retained their specified function.

Protease function after conjugation may be tested by using, for example, any one of the following routine tests:

SNAP-25 (or synaptobrevin, or syntaxin) may be challenged with a conjugate to be tested, and then analysed by SDS-PAGE peptide separation techniques. Subsequent detection of peptides (e.g. by silver staining) having molecular weights corresponding to the cleaved products of SNAP-25 (or other component of the neurosecretory machinery) is would confirm the presence of a functional L-chain.

As a further alternative, the conjugate may be tested by assaying for SNAP-25 (or synaptobrevin, or syntaxin) cleavage products via antibody-specific binding (see WO95/33850). In more detail, a specific antibody is employed for detecting cleavage of SNAP-25. Since the antibody recognises cleaved SNAP-25, but not uncleaved SNAP-25, identification of the cleaved product by the antibody confirms the presence of L-chain proteolytic function. By way of exemplification, such a method is described in Examples 2 and 3 of WO96/33273.

Translocation component function after conjugation may be tested using, for example, any one of the following routine tests:

Suitable methods are, for example, described by Shone et al. (1987) Eur. J. Biochem. 167, pp. 175-180; and by Blaustein et al. (1987) FEBS 226 (1), pp. 115-120.

The Shone et al. method employs artificial liposomes loaded with potassium phosphate buffer (pH 7.2) and radiolabelled NAD. Release of K+ and NAD from the liposomes correlates with a positive result for channel forming activity and hence translocation activity. In this regard, K+ release from liposomes may be measured using an electrode and NAD release calculated by measuring the radioactivity in the supernatant (see page 176, column 1, line 33-column 2, line 17).

The Blaustein et al. method employs planar phospholipid bilayer membranes, which are used to test for channel forming activity. In more detail, salt solutions on either side of the membrane are buffered at a different pH—on the cis side, pH 4.7 or 5.5 and on the trans side, pH 7.4. The "conjugate" to be tested is added to the cis side of the membrane and electrical measurements are made under voltage clamp conditions, in to order to monitor the flow of current across the membrane (see paragraph 2.2, pages 116-118). The presence of an active translocation function is confirmed by a steady rate of channel turn-on (i.e. a positive result for channel formation)—see paragraph 3, page 118.

Targeting Moiety (TM) function after conjugation may be tested by assaying for the agonist function inherent to the TM. Suitable methods include those described in

EXAMPLE 1

The ability of the conjugate of the invention to inhibit substance P release from nociceptive afferent cells can be assessed using the methods described in Example 15.

In Example 15, a nociceptin-LHN/A conjugate according to the first aspect of the invention is assessed for its ability to inhibit the release of substance P from primary nociceptive sensory afferent neurons. As can be seen from Table 1, incubation of the conjugate with cultures of nociceptive afferent neurons results in a significant inhibition of release of substance P (when compared to incubation of the cells with LHN/A alone). The experiment therefore confirms that the conjugate is inhibiting substance P release from these cells.

In use of the present invention, a pain-sensing target cell is selected in which it is desired to reduce or inhibit the process of exocytic fusion, which exocytic process contributes to the symptoms associated with the sensation of pain. For example, the target cell in question may demonstrate an undesirable phenotype (e.g. an undesirable secretion, or the expression of an undesirable concentration of membrane receptor, transporter or membrane channel), which contributes to the symptoms associated with pain. Alternatively, a target cell may be selected in which the process of exocytic fusion contributes to the sensation of pain.

In preferred embodiments of the invention, the target cell is a nociceptive sensory afferent cell, preferably a primary nociceptive afferent cell (e.g. an A-fibre such as an Aδ-fibre or a C-fibre). Thus, the conjugates of the present invention are capable of inhibiting neurotransmitter or neuromodulator (e.g. glutamate, substance P, calcitonin-gene related peptide (CGRP), and/or neuropeptide Y) release from discrete populations to of nociceptive sensory afferent neurons. In use, the conjugates reduce or prevent the transmission of sensory afferent signals (e.g. neurotransmitters or neuromodulators) from peripheral to central pain fibres, and therefore have application as therapeutic molecules for the treatment of pain, in particular chronic pain.

It is routine to confirm that a TM binds to a nociceptive sensory afferent. For example, a simple radioactive displacement experiment may be employed in which tissue or cells representative of the nociceptive sensory afferent (for example DRGs) are exposed to labelled (e.g. tritiated) ligand in the presence of an excess of unlabelled ligand. In such an experiment, the relative proportions of non-specific and specific binding may be assessed, thereby allowing confirmation that the ligand binds to the nociceptive sensory afferent target cell. Optionally, the assay may include one or more binding antagonists, and the assay may further comprise observing a loss of ligand binding. Examples of this type of experiment can be found in Hulme, E. C. (1990), Receptor-binding studies, a brief outline, pp 303-311, in Receptor biochemistry, A Practical Approach, Ed. E. C. Hulme, Oxford University Press.

According to a second aspect, the present invention provides a non-cytotoxic conjugate for inhibition or reduction of exocytotic fusion in a nociceptive sensory afferent cell, comprising:

(i) a Targeting Moiety (TM), wherein said TM is an agonist of a receptor that is present on said nociceptive sensory afferent cell, and wherein said receptor undergoes endocytosis to be incorporated into an endosome within the nociceptive sensory afferent cell;

(ii) a DNA sequence encoding a non-cytotoxic protease or a fragment thereof, wherein the DNA sequence is expressible in the nociceptive sensory afferent cell and when so expressed provides a protease or protease fragment capable of cleaving a protein of the exocytic fusion apparatus of said nociceptive sensory afferent cell; and (iii) a Translocation Domain, wherein the Translocation Domain translocates the DNA sequence encoding the protease or protease fragment from within the endosome, across the endosomal membrane, and into the nociceptive sensory afferent cell.

In a preferred embodiment of the invention, the target for the TM is selected from the group consisting of: Mrg receptors such as MrgX1, opiod receptors such as OPRD1 and/or OPRM1, BDKRB1 and/or BDKRB2, Tachykinin receptors such as TACR1, TACR2 and/or TACR3, Kappa receptor (OPRK1) and/or $ORL_1$ receptor.

In one embodiment, the TM is a molecule that binds (preferably that specifically binds) to one or more of the above-mentioned receptors. For example, the TM is an "agonist" of one or more of the above-mentioned receptors. The term "agonist" in this context is defined as above.

In one embodiment, the TM comprises or consists of a BAM peptide. Full-length BAM is a 22 amino acid peptide, abbreviated herein as BAM1-22 (represented by SEQ ID NO: 120). In one embodiment, the BAM TM of the invention comprises or consists of a 15 amino acid fragment of full-length BAM peptide and is referred to herein as BAMS-22 (represented by SEQ ID NO: 121). In one embodiment, said BAM peptides bind (preferably specifically bind) to Mrg receptors such as MrgX1.

In one embodiment, the TM comprises or consists of a β-endorphin peptide. β-endorphin is a 31 amino acid peptide (represented by SEQ ID NO: 126). In one embodiment, said β-endorphin peptide binds (preferably specifically binds) opioid receptors such as OPRD1 and/or OPRM1.

In one embodiment, the TM comprises or consists of a bradykinin peptide. bradykinin is a 9 amino acid peptide (represented by SEQ ID NO: 129). In one embodiment, said bradykinin peptide binds (preferably specifically binds) bradykinin target receptors BDKRB1 and/or BDKRB2.

In one embodiment, the TM comprises or consists of a des-$Arg^9$-BK ligand (represented by SEQ ID NO: 130). The des-Arg9-Bradykinin ligand differs from bradykinin ligand by the removal of an arginine residue from the C-terminus. In one embodiment, said des-$Arg^9$-BK ligand binds (preferably specifically binds) bradykinin target receptors BDKRB1 and/or BDKRB2.

In one embodiment, the TM comprises or consists of a substance P peptide. Full length substance P is an 11 amino acid peptide (represented by SEQ ID NO: 134). In one embodiment, the TM comprises or consists of a substance P analogue, such as the analogue referred to herein as 'S6' (represented by SEQ ID NO: 135). In one embodiment, said substance P peptide, or analogue thereof binds (preferably specifically binds) to Tachykinin receptors such as TACR1, TACR2 and/or TACR3.

In one embodiment, the TM comprises or consists of a dynorphin peptide. The sequence of dynorphin is represented by SEQ ID NO: 101. In one embodiment, said dynorphin peptide binds (preferably specifically binds) Kappa receptor (OPRK1).

The invention also encompasses fragments, variants, and derivatives and analogues of the above-mentioned TMs. These fragments, variants, and derivatives and analogues substantially retain the properties that are ascribed to said TM. For example, the fragments, variants, and derivatives may retain the ability to bind to their respective receptor(s). By way of example, reference is made to the above-mentioned BAM8-22 fragment of the full length BAM1-22 TM as well as the substance P analogue S6.

In one embodiment, the TM comprises or consist of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NO: 2, 4, 12, 101, 120, 121, 126, 129, 130, 134 and/or 135.

In one embodiment, the TM comprises or consist of an amino acid sequence having at least 70%, preferably at least 80% (such as at least 82, 84, 85, 86, 88 or 89%), more preferably at least 90% (such as at least 91, 92, 93 or 94%), and most preferably at least 95% (such as at least 96, 97, 98, 99 or 100%) amino acid sequence acid identity to SEQ ID NO: 120, 121, 126, 129, 130, 134 and/or 135.

In one embodiment, the Targeting Moiety comprises or consists of an amino acid sequence according to SEQ ID NO: 120, 121, 126, 129, 130, 134 and/or 135 or a fragment comprising or consisting of at least 16 (such as at least 5, 6, 7, 8, 9, 10, 11, 12, 13, 14 or 15) contiguous amino acid residues thereof, or a variant amino acid sequence of said SEQ ID NO: 120, 121, 126, 129, 130, 134 and/or 135 or said fragment is having a maximum of 6 (such as a maximum of 5, 4, 3, 2 or 1) conservative amino acid substitutions.

DNA encoding a protein of interest can be transfected into eukaryotic cells through receptor-mediated endocytosis of a protein-DNA conjugate, as confirmed by Cotton et al. (Cotton, M., Wagner, E. and Birnstiel, L. (1993) Receptor-mediated transport of DNA into eukaryotic cells. Methods in Enzymol. 217, 619-645). Several methods exist for condensing DNA to a suitable size using polycationic ligands. These include: polylysine, various cationic peptides and cationic liposomes. Of these, polylysine was used in the present study because of its successfully reported use in receptor-mediated transfection studies (Cotton et al., 1993).

The DNA sequence encoding the non-cytotoxic protease component may be expressed under the control of an operably linked promoter present as part of the agent (e.g. as part of the protease DNA sequence upstream of the coding region). Alternatively, expression of the protease component in the target cell may rely on a promoter present in the target cell.

The DNA sequence encoding the protease component may integrate into a DNA sequence of the target cell. One or more integration site(s) may be provided as part of the conjugate (e.g. as part of the protease DNA sequence).

The TM, Translocation Domain and protease components of this second aspect of the invention are as defined for the first aspect of the invention. Examples 13 and 14 describe the preparation of conjugates according to the second aspect of the invention.

According to a third aspect, the present invention provides a pharmaceutical composition comprising a conjugate according to the first and/or second aspect of the present invention.

The pharmaceutical composition may further comprise a pharmaceutically-acceptable carrier, and/or a suitable diluent and/or excipient, although the exact form of the composition may be tailored to the mode of administration. Administration is preferably to a mammal, more preferably to a human.

The components of the composition may, for example, be employed in the form of an aerosol or nebulisable solution for inhalation or a sterile solution for parenteral administration, intra-articular administration or intra-cranial administration.

The composition may also be administered by i.v. injection, which includes the use of pump systems. Spinal injection (e.g. epidural or intrathecal) or indwelling pumps may also be used.

The dosage ranges for administration of the components of the present invention are those to produce the desired therapeutic effect. It will be appreciated that the dosage range required depends on the precise nature of the components, the route of administration, the nature of the formulation, the age of the patient, the nature, extent or severity of the patient's condition, contraindications, if any, and the judgement of the attending physician.

Suitable daily dosages (for each component) are in the range 0.0001-1 mg/kg, preferably 0.0001-0.5 mg/kg, more preferably 0.002-0.5 mg/kg, and particularly preferably 0.004-0.5 mg/kg. The unit dosage can vary from less that 1 microgram to 30 mg, but typically will be in the region of 0.01 to 1 mg per dose, which may be administered daily or preferably less frequently, such as weekly or six monthly.

A particularly preferred dosing regimen is based on 2.5 ng of fusion protein (e.g. CPNv/A) as the 1× dose. In this regard, preferred dosages are in the range 1×-100× (i.e. 2.5-250 ng). This dosage range is significantly lower (i.e. at least 10-fold, typically 100-fold lower) than would be employed with other types of analgesic molecules such as NSAIDS, morphine, and gabapentin. Moreover, the above-mentioned difference is to considerably magnified when the same comparison is made on a molar basis—this is because the fusion proteins of the present invention have a considerably greater Mw than do conventional 'small' molecule therapeutics.

Wide variations in the required dosage, however, are to be expected depending on the is precise nature of the components, and the differing efficiencies of various routes of administration. For example, oral administration would be expected to require higher dosages than administration by intravenous injection.

Variations in these dosage levels can be adjusted using standard empirical routines for optimisation, as is well understood in the art.

Compositions suitable for injection may be in the form of solutions, suspensions or emulsions, or dry powders which are dissolved or suspended in a suitable vehicle prior to use.

Fluid unit dosage forms are typically prepared utilising a pyrogen-free sterile vehicle. The active ingredients, depending on the vehicle and concentration used, can be either dissolved or suspended in the vehicle.

Solutions may be used for all forms of parenteral administration, and are particularly used for intravenous injection. In preparing solutions the components can be dissolved in the vehicle, the solution being made isotonic if necessary by addition of sodium chloride and sterilised by filtration through a sterile filter using aseptic techniques before filling into suitable sterile vials or ampoules and sealing. Alternatively, if solution stability is adequate, the solution in its sealed containers may be sterilised by autoclaving.

Advantageously additives such as buffering, solubilising, stabilising, preservative or bactericidal, suspending or emulsifying agents and/or local anaesthetic agents may be dissolved in the vehicle.

Dry powders which are dissolved or suspended in a suitable vehicle prior to use may be prepared by filling pre-sterilised drug substance and other ingredients into a sterile to container using aseptic technique in a sterile area.

Alternatively the components of the composition may be dissolved in an aqueous vehicle, the solution is sterilized by filtration and distributed into suitable containers using aseptic technique in a sterile area. The product is then freeze-dried and the is containers are sealed aseptically.

Parenteral suspensions, suitable for intramuscular, subcutaneous or intradermal injection, are prepared in substantially the same manner, except that the sterile components are suspended in the sterile vehicle, instead of being dissolved and sterilisation cannot be accomplished by filtration. The components may be isolated in a sterile state or alternatively it may be sterilised after isolation, e.g. by gamma irradiation.

Advantageously, a suspending agent for example polyvinylpyrrolidone is included in the composition(s) to facilitate uniform distribution of the components.

Compositions suitable for administration via the respiratory tract include aerosols, nebulisable solutions or microfine powders for insufflation. In the latter case, particle size of less than 50 microns, especially less than 10 microns, is preferred. Such compositions may be made up in a conventional manner and employed in conjunction with conventional administration devices.

The compositions described in this invention can be used in vivo, either directly or as a pharmaceutically acceptable salt, for the treatment of conditions involving exocytosis (for example secretion, or the delivery of proteins such as receptors, transporters, and membrane channels to the plasma membrane of a cell).

According to a fourth aspect, the present invention provides a DNA construct that encodes a conjugate according to the first or second aspects of the invention.

By expressing the construct in a host cell, conjugates of the invention may be prepared.

According to a fifth aspect, the present invention provides a method of treatment of pain by administration to a patient of a conjugate, composition, or construct according to the first to fourth aspects of the invention, or any combination thereof.

In a preferred embodiment, the invention provides a method of treating chronic pain.

According to a sixth aspect, the present invention provides for the use of a conjugate, composition or construct according to the first to fourth aspects of the invention, for the manufacture of a medicament for treating pain, preferably chronic pain.

According to a further aspect of the present invention, there is provided use of a conjugate of the invention, for the manufacture of a medicament for treating, preventing or ameliorating pain. According to a related aspect, there is provided a method of treating, preventing or ameliorating pain in a subject, comprising administering to said patient a therapeutically effective amount of a conjugate or composition of the invention.

The conjugates and compositions described here may be used to treat a patient suffering from one or more types of chronic pain including neuropathic pain, inflammatory pain, headache pain, somatic pain, visceral pain, and referred pain.

To "treat," as used here, means to deal with medically. It includes, for example, administering a compound of the invention to prevent pain or to lessen its severity.

The term "pain," as used here, means any unpleasant sensory experience, usually associated with a physical disorder. The physical disorder may or may not be apparent to a clinician. Pain is of two types: chronic and acute. An "acute pain" is a pain of short duration having a sudden onset. One type of acute pain, for example, is cutaneous pain felt on injury to the skin or other superficial tissues, such as caused by a cut or a burn. Cutaneous nociceptors terminate just below the skin, and due to the high concentration of nerve endings, produce a well-defined, localized pain of short duration. "Chronic pain" is a pain other than an acute pain. Chronic pain includes neuropathic pain, inflammatory pain, headache pain, somatic pain visceral pain and referred pain.

I. Neuropathic Pain

The compounds of the invention may be used to treat pain caused by or otherwise associated with any of the following neuropathic pain conditions. "Neuropathic pain" means abnormal sensory input, resulting in discomfort, from the peripheral nervous system, central nervous systems, or both.

A. Symptoms of Neuropathic Pain

Symptoms of neuropathic pain can involve persistent, spontaneous pain, as well as allodynia (a painful response to a stimulus that normally is not painful), hyperalgesia (an accentuated response to a painful stimulus that usually causes only a mild discomfort, such as a pin prick), or hyperpathia (where a short discomfort becomes a prolonged severe pain).

B. Causes of Neuropathic Pain

Neuropathic pain may be caused by any of the following.

1. A traumatic insult, such as, for example, a nerve compression injury (e.g., a nerve crush, a nerve stretch, a nerve entrapment or an incomplete nerve transsection); a spinal cord injury (e.g., a hemisection of the spinal cord); a limb amputation; a contusion; an inflammation (e.g., an inflammation of the spinal cord); or a surgical procedure.
2. An ischemic event, including, for example, a stroke and heart attack.
3. An infectious agent
4. Exposure to a toxic agent, including, for example, a drug, an alcohol, a heavy metal (e.g., lead, arsenic, mercury), an industrial agent (e.g., a solvent, fumes from a glue) or nitrous oxide.
5. A disease, including, for example, an inflammatory disorder, a neoplastic tumor, an acquired immune deficiency syndrome (AIDS), Lymes disease, a leprosy, a metabolic disease, a peripheral nerve disorder, like neuroma, a mononeuropathy or a polyneuropathy.

C. Types of Neuropathic Pain

1. Neuralgia.

A neuralgia is a pain that radiates along the course of one or more specific nerves usually without any demonstrable pathological change in the nerve structure. The causes of neuralgia are varied. Chemical irritation, inflammation, trauma (including surgery), compression by nearby structures (for instance, tumors), and infections may all lead to neuralgia. In many cases, however, the cause is unknown or unidentifiable. Neuralgia is most common in elderly persons, but it may occur at any age. A neuralgia, includes, without limitation, a trigeminal neuralgia, a post-herpetic neuralgia, a postherpetic neuralgia, a glossopharyngeal neuralgia, a sciatica and an atypical facial pain.

Neuralgia is pain in the distribution of a nerve or nerves. Examples are trigeminal neuralgia, atypical facial pain, and postherpetic neuralgia (caused by shingles or herpes). The affected nerves are responsible for sensing touch, temperature and pressure in the facial area from the jaw to the forehead. The disorder generally causes short episodes of excruciating pain, usually for less than two minutes and on only one side of the face. The pain can be described in a variety of ways such as "stabbing," "sharp," "like lightning," "burning," and even "itchy". In the atypical form of TN, the pain can also present as severe or merely aching and last for extended periods. The pain associated with TN is recognized as one the most excruciating pains that can be experienced.

Simple stimuli such as eating, talking, washing the face, or any light touch or sensation can trigger an attack (even the sensation of a gentle breeze). The attacks can occur in clusters or as an isolated attack.

Symptoms include sharp, stabbing pain or constant, burning pain located anywhere, usually on or near the surface of the body, in the same location for each episode; pain along the path of a specific nerve; impaired function of affected body part due to pain, or muscle weakness due to concomitant motor nerve damage; increased sensitivity of the skin or numbness of the affected skin area (feeling similar to a local anesthetic such as to a Novocaine shot); and any touch or pressure is interpreted as pain. Movement may also be painful.

Trigeminal neuralgia is the most common form of neuralgia. It affects the main sensory nerve of the face, the trigeminal nerve ("trigeminal" literally means "three origins", is referring to the division of the nerve into 3 branches). This condition involves sudden and short attacks of severe pain on the side of the face, along the area supplied by the trigeminal nerve on that side. The pain attacks may be severe enough to cause a facial grimace, which is classically referred to as a painful tic (tic douloureux). Sometimes, the cause of trigeminal neuralgia is a blood vessel or small tumor pressing on the nerve. Disorders such as multiple sclerosis (an inflammatory disease affecting the brain and spinal cord), certain forms of arthritis, and diabetes (high blood sugar) may also cause trigeminal neuralgia, but a cause is not always identified. In this condition, certain movements such as chewing, talking, swallowing, or touching an area of the face may trigger a spasm of excruciating pain.

A related but rather uncommon neuralgia affects the glosso-pharyngeal nerve, which provides sensation to the throat. Symptoms of this neuralgia are short, shock-like episodes of pain located in the throat.

Neuralgia may occur after infections such as shingles, which is caused by the varicella-zoster virus, a type of herpesvirus. This neuralgia produces a constant burning pain after the shingles rash has healed. The pain is worsened by movement of or contact with the affected area. Not all of those diagnosed with shingles go on to experience postherpetic neuralgia, which can be more painful than shingles. The pain and sensitivity can last for months or even years. The pain is usually in the form of an intolerable sensitivity to any touch but especially light touch. Postherpetic neuralgia is not restricted to the face; it can occur anywhere on the body but usually occurs at the location of the shingles rash. Depression is not uncommon due to the pain and social isolation during the illness.

Postherpetic neuralgia may be debilitating long after signs of the original herpes infection have disappeared. Other infectious diseases that may cause neuralgia are syphilis and Lyme disease.

Diabetes is another common cause of neuralgia. This very common medical problem affects almost 1 out of every 20 Americans during adulthood. Diabetes damages the tiny arteries that supply circulation to the nerves, resulting in nerve fiber malfunction and sometimes nerve loss. Diabetes can produce almost any neuralgia, including trigeminal neuralgia, carpal tunnel syndrome (pain and numbness of the hand and wrist), and meralgia paresthetica (numbness and pain in the thigh due to damage to the lateral femoral cutaneous nerve). Strict control of blood sugar may prevent diabetic nerve damage and may accelerate recovery in patients who do develop neuralgia.

Other medical conditions that may be associated with neuralgias are chronic renal insufficiency and porphyria—a hereditary disease in which the body cannot rid itself of certain substances produced after the normal breakdown of blood in the body. Certain drugs may also cause this problem.

2. Deafferentation.

Deafferentation indicates a loss of the sensory input from a portion of the body, and can be caused by interruption of either peripheral sensory fibres or nerves from the central nervous system. A deafferentation pain syndrome, includes, without limitation, an injury to the brain or spinal cord, a post-stroke pain, a phantom pain, a paraplegia, a brachial plexus avulsion injuries, lumbar radiculopathies.

3. Complex Regional Pain Syndromes (CRPSs)

CRPS is a chronic pain syndrome resulting from sympathetically-maintained pain, and presents in two forms. CRPS 1 currently replaces the term "reflex sympathetic dystrophy syndrome". It is a chronic nerve disorder that occurs most often in the arms or legs after a minor or major injury. CRPS 1 is associated with severe pain; changes in the nails, bone, and skin; and an increased sensitivity to touch in the affected limb. CRPS 2 replaces the term causalgia, and results from an identified injury to the nerve. A CRPS, includes, without limitation, a CRPS Type I (reflex sympathetic dystrophy) and a CRPS Type II (causalgia).

4. Neuropathy.

A neuropathy is a functional or pathological change in a nerve and is characterized clinically by sensory or motor neuron abnormalities.

Central neuropathy is a functional or pathological change in the central nervous system.

Peripheral neuropathy is a functional or pathological change in one or more peripheral nerves. The peripheral nerves relay information from your central nervous system (brain and spinal cord) to muscles and other organs and from your skin, joints, and other organs back to your brain. Peripheral neuropathy occurs when these nerves fail to carry information to and from the brain and spinal cord, resulting in pain, loss of sensation, or inability to control muscles. In some cases, the failure of nerves that control blood vessels, intestines, and other organs results in abnormal blood pressure, digestion problems, and loss of other basic body processes. Risk factors for neuropathy include diabetes, heavy alcohol use, and exposure to certain chemicals and drugs. Some people have a hereditary predisposition for neuropathy. Prolonged pressure on a nerve is another risk for developing a nerve injury. Pressure injury may be caused by prolonged immobility (such as a long surgical procedure or lengthy illness) or compression of a nerve by casts, splints, braces, crutches, or other devices. Polyneuropathy implies a widespread process that usually affects both sides of the body equally. The symptoms depend on which type of nerve is affected. The three main types of nerves are sensory, motor, and autonomic. Neuropathy can affect any one or a combination of all three types of nerves. Symptoms also depend on whether the condition affects the whole body or just one nerve (as from an injury). The cause of chronic inflammatory polyneuropathy is an abnormal immune response. The specific antigens, immune processes, and triggering factors are variable and in many cases are unknown. It may occur in association with other conditions such as HIV, inflammatory bowel disease, lupus erythematosis, chronic active hepatitis, and blood cell abnormalities.

Peripheral neuropathy may involve a function or pathological change to a single nerve or nerve group (monneuropathy) or a function or pathological change affecting multiple nerves (polyneuropathy).

Peripheral Neuropathies

Hereditary Disorders

Charcot-Marie-Tooth disease

Friedreich's ataxia

Systemic or Metabolic Disorders

Diabetes (diabetic neuropathy)
Dietary deficiencies (especially vitamin B-12)
Excessive alcohol use (alcoholic neuropathy)
Uremia (from kidney failure)
Cancer Infectious or Inflammatory Conditions
AIDS
Hepatitis
Colorado tick fever
diphtheria
Guillain-Barre syndrome
HIV infection without development of AIDS
leprosy
Lyme
polyarteritis nodosa
rheumatoid arthritis
sarcoidosis
Sjogren syndrome
syphilis
systemic lupus erythematosus
amyloid Exposure to Toxic Compounds
sniffing glue or other toxic compounds
nitrous oxide
industrial agents—especially solvents
heavy metals (lead, arsenic, mercury, etc.)
Neuropathy secondary to drugs like analgesic nephropathy Miscellaneous Causes
ischemia (decreased oxygen/decreased blood flow)
prolonged exposure to cold temperature a. Polyneuropathy Polyneuropathy is a peripheral neuropathy involving the loss of movement or is sensation to an area caused by damage or destruction to multiple peripheral nerves. Polyneuropathic pain, includes, without limitation, post-polio syndrome, post-mastectomy syndrome, diabetic neuropathy, alcohol neuropathy, amyloid, toxins, AIDS, hypothyroidism, uremia, vitamin deficiencies, chemotherapy-induced pain, 2',3'-didexoycytidine (ddC) treatment, Guillain-Barré syndrome or Fabry's disease.

b. Mononeuropathy

Mononeuropathy is a peripheral neuropathy involving loss of movement or sensation to an area caused by damage or destruction to a single peripheral nerve or nerve group. Mononeuropathy is most often caused by damage to a local area resulting from injury or trauma, although occasionally systemic disorders may cause isolated nerve damage (as with mononeuritis multiplex). The usual causes are direct trauma, prolonged pressure on the nerve, and compression of the nerve by swelling or injury to nearby body structures. The damage includes destruction of the myelin sheath (covering) of the nerve or of part of the nerve cell (the axon). This damage slows or prevents conduction of impulses through the nerve. Mononeuropathy may involve any part of the body. Mononeuropathic pain, includes, without limitation, a sciatic nerve dysfunction, a common peroneal nerve dysfunction. a radial nerve dysfunction, an ulnar nerve dysfunction, a cranial mononeuropathy VI, a cranial mononeuropathy VII, a cranial mononeuropathy III (compression type), a cranial mononeuropathy III (diabetic type), an axillary nerve dysfunction, a carpal tunnel syndrome, a femoral nerve dysfunction, a tibial nerve dysfunction, a Bell's palsy, a thoracic outlet syndrome, a carpal tunnel syndrome and a sixth (abducent) nerve palsy c. Generalized Peripheral Neuropathies Generalized peripheral neuropathies are symmetrical, and usually due to various systematic illnesses and disease processes that affect the peripheral nervous system in its entirety. They are further subdivided into several categories:

i. Distal axonopathies are the result of some metabolic or toxic derangement of neurons. They may be caused by metabolic diseases such as diabetes, renal failure, deficiency syndromes such as malnutrition and alcoholism, or the effects of toxins or drugs. Distal axonopathy (aka dying back neuropathy) is a type of peripheral neuropathy that results from some metabolic or toxic derangement of peripheral nervous system (PNS) neurons. It is the most common response of nerves to metabolic or toxic disturbances, and as such may be caused by metabolic diseases such as diabetes, is renal failure, deficiency syndromes such as malnutrition and alcoholism, or the effects of toxins or drugs. The most common cause of distal axonopathy is diabetes, and the most common distal axonopathy is diabetic neuropathy.

ii. Myelinopathies are due to a primary attack on myelin causing an acute failure of impulse conduction. The most common cause is acute inflammatory demyelinating polyneuropathy (AIDP; aka Guillain-Barré syndrome), though other causes include chronic inflammatory demyelinating syndrome (CIDP), genetic metabolic disorders (e.g., leukodystrophy), or toxins. Myelinopathy is due to primary destruction of myelin or the myelinating Schwann cells, which leaves the axon intact, but causes an acute failure of impulse conduction. This demyelination slows down or completely blocks the conduction of electrical impulses through the nerve. The most common cause is acute inflammatory demyelinating polyneuropathy (AIDP, better known as Guillain-Barré syndrome), though other causes include chronic inflammatory demyelinating polyneuropathy (CIDP), genetic metabolic disorders (e.g., leukodystrophy or Charcot-Marie-Tooth disease), or toxins.

iii. Neuropathies are the result of destruction of peripheral nervous system (PNS) neurons. They may be caused by motor neurone diseases, sensory neuronopathies (e.g., Herpes zoster), toxins or autonomic dysfunction. Neurotoxins may cause neuronopathies, such as the chemotherapy agent vincristine. Neuropathy is dysfunction due to damage to neurons of the peripheral nervous system (PNS), resulting in a peripheral neuropathy. It may be caused by motor neurone diseases, sensory neuronopathies (e.g., Herpes zoster), toxic substances or autonomic dysfunction. A person with neuropathy may present in different ways, depending on the cause, the way it affects the nerve cells, and the type of nerve cell that is most affected.

iv. Focal Entrapment Neuropathies (e.g., Carpal Tunnel Syndrome).

II. Inflammatory Pain

The compounds of the invention may be used to treat pain caused by or otherwise associated with any of the following inflammatory conditions A. Arthritic Disorder Arthritic disorders include, for example, a rheumatoid arthritis; a juvenile rheumatoid is arthritis; a systemic lupus erythematosus (SLE); a gouty arthritis; a scleroderma; an osteoarthritis; a psoriatic arthritis; an ankylosing spondylitis; a Reiter's syndrome (reactive arthritis); an adult Still's disease; an arthritis from a viral infection; an arthritis from a bacterial infection, such as, e.g., a gonococcal arthritis and a non-gonococcal bacterial arthritis (septic arthritis); a Tertiary Lyme disease; a tuberculous arthritis; and an arthritis from a fungal infection, such as, e.g. a blastomycosis B. Autoimmune Diseases Autoimmune diseases include, for example, a Guillain-Barré syndrome, a Hashimoto's thyroiditis, a pernicious anemia, an Addison's disease, a type I diabetes, a systemic lupus erythematosus, a dermatomyositis, a Sjogren's syndrome, a lupus erythematosus, a multiple sclerosis, a myasthenia gravis, a Reiter's syndrome and a Grave's disease.

C. Connective Tissue Disorder

Connective tissue disorders include, for example, a spondyloarthritis a dermatomyositis, and a fibromyalgia.

D. Injury

Inflammation caused by injury, including, for example, a crush, puncture, stretch of a tissue or joint, may cause chronic inflammatory pain.

E. Infection

Inflammation caused by infection, including, for example, a tuberculosis or an interstitial keratitis may cause chronic inflammatory pain.

F. Neuritis

Neuritis is an inflammatory process affecting a nerve or group of nerves. Symptoms depend on the nerves involved, but may include pain, paresthesias, paresis, or hypesthesia (numbness).

Examples include:

a. Brachial neuritis b. Retrobulbar neuropathy, an inflammatory process affecting the part of the optic nerve lying immediately behind the eyeball.

c. Optic neuropathy, an inflammatory process affecting the optic nerve causing sudden, reduced vision in the affected eye. The cause of optic neuritis is unknown. The sudden inflammation of the optic nerve (the nerve connecting the eye and the brain) leads to swelling and destruction of the myelin sheath. The inflammation may occasionally be the result of a viral infection, or it may be caused by autoimmune diseases such as multiple sclerosis. Risk factors are related to the possible causes.

d. Vestibular neuritis, a viral infection causing an inflammatory process affecting the vestibular nerve.

G. Joint Inflammation

Inflammation of the joint, such as that caused by bursitis or tendonitis, for example, may cause chronic inflammatory pain.

III. Headache Pain

The compounds of the invention may be used to treat pain caused by or otherwise associated with any of the following headache conditions. A headache (medically known as cephalgia) is a condition of mild to severe pain in the head; sometimes neck or upper back pain may also be interpreted as a headache. It may indicate an underlying local or systemic disease or be a disorder in itself.

A. Muscular/Myogenic Headache

Muscular/myogenic headaches appear to involve the tightening or tensing of facial and neck muscles; they may radiate to the forehead. Tension headache is the most common form of myogenic headache.

A tension headache is a condition involving pain or discomfort in the head, scalp, or neck, usually associated with muscle tightness in these areas. Tension headaches result from the contraction of neck and scalp muscles. One cause of this muscle contraction is a response to stress, depression or anxiety. Any activity that causes the head to be held in one position for a long time without moving can cause a headache. Such activities include typing or use of computers, fine work with the hands, and use of a microscope. Sleeping in a cold room or sleeping with the neck in an abnormal position may also trigger this type of headache. A tension-type headache, includes, without limitation, an episodic tension headache and a chronic tension headache.

B. Vascular Headache

The most common type of vascular headache is migraine. Other kinds of vascular headaches include cluster headaches, which cause repeated episodes of intense pain, and headaches resulting from high blood pressure 1. Migraine A migraine is a heterogeneous disorder that generally involves recurring headaches. Migraines are different from other headaches because they occur with other symptoms, such as, e.g., nausea, vomiting, or sensitivity to light. In most people, a throbbing pain is felt only on one side of the head. Clinical features such as type of aura symptoms, presence of prodromes, or associated symptoms such as vertigo, may be seen in subgroups of patients with different underlying pathophysiological and genetic mechanisms. A migraine headache, includes, without limitation, a migraine without aura (common migraine), a migraine with aura (classic migraine), a menstrual migraine, a migraine equivalent (acephalic headache), a complicated migraine, an abdominal migraine and a mixed tension migraine.

2. Cluster Headache

Cluster headaches affect one side of the head (unilateral) and may be associated with tearing of the eyes and nasal congestion. They occurs in clusters, happening repeatedly every day at the same time for several weeks and then remitting.

D. High Blood Pressure Headache

E. Traction and Inflammatory Headache

Traction and inflammatory headaches are usually symptoms of other disorders, ranging from stroke to sinus infection.

F. Hormone Headache

G. Rebound Headache

Rebound headaches, also known as medication overuse headaches, occur when is medication is taken too frequently to relieve headache. Rebound headaches frequently occur daily and can be very painful.

H. Chronic Sinusitis Headache

Sinusitis is inflammation, either bacterial, fungal, viral, allergic or autoimmune, of the paranasal sinuses. Chronic sinusitis is one of the most common complications of the common cold. Symptoms include: Nasal congestion; facial pain; headache; fever; general malaise; thick green or yellow discharge; feeling of facial 'fullness' worsening on bending over. In a small number of cases, chronic maxillary sinusitis can also be brought on by the spreading of bacteria from a dental infection. Chronic hyperplastic eosinophilic sinusitis is a noninfective form of chronic sinusitis.

I. An Organic Headache

J. Ictal Headaches

Ital headaches are headaches associated with seizure activity.

IV. Somatic Pain

The compounds of the invention may be used to treat pain caused by or otherwise associated with any of the following somatic pain conditions. Somatic pain originates from ligaments, tendons, bones, blood vessels, and even nerves themselves. It is detected with somatic nociceptors. The scarcity of pain receptors in these areas produces a dull, poorly-localized pain of longer duration than cutaneous pain; examples include sprains and broken bones. Additional examples include the following.

A. Excessive Muscle Tension

Excessive muscle tension can be caused, for example, by a sprain or a strain.

B. Repetitive Motion Disorders

Repetitive motion disorders can result from overuse of the hands, wrists, elbows, shoulders, neck, back, hips, knees, feet, legs, or ankles.

C. Muscle Disorders

Muscle disorders causing somatic pain include, for example, a polymyositis, a dermatomyositis, a lupus, a fibromyalgia, a polymyalgia rheumatica, and a rhabdomyolysis.

D. Myalgia

Myalgia is muscle pain and is a symptom of many diseases and disorders. The most common cause for myalgia is either overuse or over-stretching of a muscle or group of muscles. Myalgia without a traumatic history is often due to viral infections. Longer-term myalgias may be indicative of a metabolic myopathy, some nutritional deficiencies or chronic fatigue syndrome.

E. Infection

Infection can cause somatic pain. Examples of such infection include, for example, an abscess in the muscle, a trichinosis, an influenza, a Lyme disease, a malaria, a Rocky Mountain spotted fever, Avian influenza, the common cold, community-acquired pneumonia, meningitis, monkeypox, Severe Acute Respiratory Syndrome, toxic shock syndrome, trichinosis, typhoid fever, and upper respiratory tract infection.

F. Drugs

Drugs can cause somatic pain. Such drugs include, for example, cocaine, a statin for lowering cholesterol (such as atorvastatin, simvastatin, and lovastatin), and an ACE inhibitor for lowering blood pressure (such as enalapril and captopril)

V. Visceral Pain

The compounds of the invention may be used to treat pain caused by or otherwise associated with any of the following visceral pain conditions. Visceral pain originates from body's viscera, or organs. Visceral nociceptors are located within body organs and internal cavities. The even greater scarcity of nociceptors in these areas produces pain that is usually more aching and of a longer duration than somatic pain. Visceral pain is extremely difficult to localise, and several injuries to visceral tissue exhibit "referred" pain, where the sensation is localised to an area completely unrelated to the site of injury. Examples of visceral pain include the following.

A. Functional Visceral Pain

Functional visceral pain includes, for example, an irritable bowel syndrome and a chronic functional abdominal pain (CFAP), a functional constipation and a functional dyspepsia, a non-cardiac chest pain (NCCP) and a chronic abdominal pain.

B. Chronic Gastrointestinal Inflammation

Chronic gastrointestinal inflammation includes, for example, a gastritis, an inflammatory bowel disease, like, e.g., a Crohn's disease, an ulcerative colitis, a microscopic colitis, a diverticulitis and a gastroenteritis; an interstitial cystitis; an intestinal ischemia; a cholecystitis; an appendicitis; a gastroesophageal reflux; an ulcer, a nephrolithiasis, an urinary tract infection, a pancreatitis and a hernia.

C. Autoimmune Pain

Autoimmune pain includes, for example, a sarcoidosis and a vasculitis.

D. Organic Visceral Pain

Organic visceral pain includes, for example, pain resulting from a traumatic, inflammatory or degenerative lesion of the gut or produced by a tumor impinging on sensory innervation.

E. Treatment-Induced Visceral Pain

Treatment-induced visceral pain includes, for example, a pain attendant to chemotherapy therapy or a pain attendant to radiation therapy.

VI. Referred Pain

The compounds of the invention may be used to treat pain caused by or otherwise associated with any of the following referred pain conditions.

Referred pain arises from pain localized to an area separate from the site of pain stimulation. Often, referred pain arises when a nerve is compressed or damaged at or is near its origin. In this circumstance, the sensation of pain will generally be felt in the territory that the nerve serves, even though the damage originates elsewhere. A common example occurs in intervertebral disc herniation, in which a nerve root arising from the spinal cord is compressed by adjacent disc material. Although pain may arise from the damaged disc itself, pain will also be felt in the region served by the compressed nerve (for example, the thigh, knee, or foot). Relieving the pressure on the nerve root may ameliorate the referred pain, provided that permanent nerve damage has not occurred. Myocardial ischaemia (the loss of blood flow to a part of the heart muscle tissue) is possibly the best known example of referred pain; the sensation can occur in the upper chest as a restricted feeling, or as an ache in the left shoulder, arm or even hand.

Definitions Section

Exocytic fusion is a process by which intracellular molecules are transported from the cytosol of a pain-sensing target cell to the plasma (i.e. cell) membrane thereof. Thereafter, the intracellular molecules may become displayed on the outer surface of the plasma membrane, or may be secreted into the extracellular environment.

In a healthy individual, the rate of exocytic fusion is carefully regulated and allows control of the transport of molecules between the cytosol and the plasma membrane of a pain-sensing cell. For example, regulation of the exocytic cycle allows control of the density of receptors, transporters, or membrane channels present at the cell's surface, and/or allows control of the secretion rate of intracellular components (e.g. neurotransmitters) from the cytosol of the cell.

However, in an unhealthy individual, the regulation of exocytic fusion may be modified. For example, exocytic fusion may cause affected pain-sensing cells to enter a state of hypersecretion. Alternatively, exocytic fusion may result in the display of an increased concentration of receptors, transporters, or membrane channels present on the surface of the pain-sensing, which may expose the cell to undesirable external stimuli. Thus, the process of exocytic fusion may contribute to the progression and/or severity of pain, and therefore provides a target for therapeutic intervention.

It should also be appreciated that otherwise normal rates of cellular exocytic fusion may contribute to the progression and severity of pain in compromised patients. Thus, by targeting exocytic fusion in accordance with the present invention, it is also possible to provide therapy in such patients Targeting Moiety (TM) means any chemical structure associated with a conjugate that functionally interacts with a receptor, e.g. an $ORL_1$ receptor, to cause a physical association between the conjugate and the surface of a pain-sensing target cell. The term TM embraces any molecule (i.e. a naturally occurring molecule, or a chemically/physically modified variant thereof) that is capable of binding to a receptor on the target cell, which receptor is capable of internalisation (e.g. endosome formation)—also referred to as receptor-mediated endocytosis. The TM may possess an endosomal membrane translocation domain, in which case separate TM and Translocation Domain components need not be present in an agent of the present invention. The TM of the present invention binds (preferably specifically binds) to a nociceptive sensory afferent (e.g. a primary nociceptive afferent). In this regard, specifically binds means that the TM binds to a nociceptive sensory afferent (e.g. a primary nociceptive afferent) with a greater affinity than it binds to other neurons such as non-nociceptive afferents, and/or to motor neurons (i.e. the natural target for clostridial neurotoxin holotoxin). The term "specifically binding" can also mean that a given TM binds to a given receptor, for Mrg receptors such as MrgX1, opiod receptors such as OPRD1 and/or OPRM1, BDKRB1 and/or BDKRB2, Tachykinin receptors such as TACR1, TACR2 and/or TACR3, Kappa receptor (OPRK1) and/or $ORL_1$ receptor, with a binding affinity (Ka) of $10^6$ $M^{-1}$ or greater, preferably $10^7$ $M^{-1}$ or greater, more preferably $10^8$ $M^{-1}$ or greater, and most preferably, $10^9$ $M^{-1}$ or greater.

The term "fragment" means a peptide having at least thirty-five, preferably at least twenty-five, more preferably at least twenty, and most preferably at least 19, 18, 17, 16, 15, 14, 13, 12, 11, 10 9, 8, 7, 6 or 5 amino acid residues of the protein (e.g. TM) in question. In one embodiment, the first amino acid residue of the fragment is the N-terminal amino acid residue of the TM from which the fragment has been derived.

An example of a "variant" is a peptide or peptide fragment of a TM that contains one or is more analogues of an amino acid (e.g. an unnatural amino acid), or a substituted linkage.

A "derivative" comprises the TM in question, and a further peptide sequence. The further peptide sequence should preferably not interfere with the basic folding and thus conformational structure of the TM. Two or more peptides (or fragments, or variants) may be joined together to form a derivative. Alternatively, a peptide (or fragment, or variant) may be joined to an unrelated molecule (e.g. a second, unrelated peptide). Derivatives may be chemically synthesized, but will be typically prepared by recombinant nucleic acid methods. Additional components such as lipid, and/or polysaccharide, and/or polyketide components may be included.

The term non-cytotoxic means that the protease molecule in question does not kill the pain-sensing target cell to which it has been re-targeted.

The "protease cleavage site" of the present invention allows cleavage (preferably controlled cleavage) of the conjugate at a position between the non-cytotoxic protease component and the TM component. In one embodiment, the conjugate may include more than one proteolytic cleavage site. However, where two or more such sites exist, they are different, thereby substantially preventing the occurrence of multiple cleavage events in the presence of a single protease. In another embodiment, it is preferred that the conjugate has a single protease cleavage site. The protease cleavage sequence(s) may be introduced (and/or any inherent cleavage sequence removed) at the DNA level by conventional means, such as by site-directed mutagenesis. Screening to confirm the presence of cleavage sequences may be performed manually or with the assistance of computer software (e.g. the MapDraw program by DNASTAR, Inc.).

Whilst any protease cleavage site may be employed, the following are preferred:

| | | |
|---|---|---|
| Enterokinase | (DDDDK↓) | SEQ ID NO: 171 |
| Factor Xa | (IEGR↓/IDGR↓) | SEQ ID NO: 172 |
| TEV(Tobacco Etch virus) | (ENLYFQ↓G) | SEQ ID NO: 173 |

-continued

| | | |
|---|---|---|
| Thrombin | (LVPR↓GS) | SEQ ID NO: 174 |
| PreScission | (LEVLFQ↓GP). | SEQ ID NO: 175 |

Also embraced by the term protease cleavage site is an intein, which is a self-cleaving sequence. The self-splicing reaction is controllable, for example by varying the concentration of reducing agent present.

SEQ ID NOs:

Where an initial Met amino acid residue or a corresponding initial codon is indicated in any of the following SEQ ID NOs, said residue/codon is optional.

SEQ ID NO:1 DNA sequence of N[1-17]
SEQ ID NO:2 Protein Sequence of N[1-17]
SEQ ID NO:3 DNA sequence of N[1-11]
SEQ ID NO:4 Protein sequence of N[1-11]
SEQ ID NO:5 DNA sequence of N[[Y10]1-11]
SEQ ID NO:6 Protein sequence of N[[Y10]1-11]
SEQ ID NO:7 DNA sequence of N[[Y11]1-11]
SEQ ID NO:8 Protein sequence of N[[Y11]1-11]
SEQ ID NO:9 DNA sequence of N[[Y14]1-17]
SEQ ID NO:10 Protein sequence of N[[Y14]1-17]
SEQ ID NO:11 DNA sequence of N[1-13]
SEQ ID NO:12 Protein sequence of N[1-13]
SEQ ID NO:13 DNA sequence of Nv (also known as N[[R14K15]1-17])
SEQ ID NO:14 Protein sequence of Nv (also known as N[[R14K15]1-17])
SEQ ID NO:15 DNA sequence of N[1-17]-$LH_N$/A fusion protein
SEQ ID NO:16 Protein sequence of N[1-17]-$LH_N$/A fusion protein
SEQ ID NO:17 DNA sequence of N[[Y11]1-11]-LHN/A fusion protein
SEQ ID NO:18 Protein sequence of N[[Y11]1-11]-LHN/A fusion protein
SEQ ID NO:19 DNA sequence of N[1-13]-LHN/A fusion protein
SEQ ID NO:20 Protein sequence of N[1-13]-LHN/A fusion protein
SEQ ID NO:21 DNA sequence of LHN/A-N[1-17] fusion protein
SEQ ID NO:22 Protein sequence of LHN/A-N[1-17] fusion protein
SEQ ID NO:23 DNA sequence of LHN/C-N[1-11] fusion protein
SEQ ID NO:24 Protein sequence of LHN/C-N[1-11] fusion protein
SEQ ID NO:25 DNA sequence of N[[Y14]1-17]-LHN/C fusion protein
SEQ ID NO:26 Protein sequence of N[[Y14]1-17]-LHN/C fusion protein
SEQ ID NO:27 DNA sequence of the LC/A
SEQ ID NO:28 DNA sequence of the $H_N$/A
SEQ ID NO:29 DNA sequence of the LC/B
SEQ ID NO:30 DNA sequence of the $H_N$/B
SEQ ID NO:31 DNA sequence of the LC/C
SEQ ID NO:32 DNA sequence of the $H_N$/C
SEQ ID NO:33 DNA sequence of the CPN-A linker
SEQ ID NO:34 DNA sequence of the A linker
SEQ ID NO:35 DNA sequence of the N-terminal presentation nociceptin insert
SEQ ID NO:36 DNA sequence of the CPN-C linker
SEQ ID NO:37 DNA sequence of the CPBE-A linker
SEQ ID NO:38 DNA sequence of the CPNvar-A linker SEQ ID NO:39 DNA sequence of the LC/A-CPN-$H_N$/A fusion SEQ ID NO:40 Protein sequence of the LC/A-CPN-$H_N$/A fusion SEQ ID NO:41 DNA sequence of the N-LC/A-$H_N$/A fusion SEQ ID NO:42 Protein sequence of the N-LC/A-$H_N$/A fusion SEQ ID NO:43 DNA sequence of the LC/C-CPN-$H_N$/C fusion SEQ ID NO:44 Protein sequence of the LC/C-CPN-$H_N$/C fusion SEQ ID NO:45 DNA sequence of the LC/C-CPN-$H_N$/C (A-linker) fusion SEQ ID NO:46 Protein sequence of the LC/C-CPN-$H_N$/C (A-linker) fusion SEQ ID NO:47 DNA sequence of the LC/A-CPME-$H_N$/A fusion SEQ ID NO:48 Protein sequence of the LC/A-CPME-$H_N$/A fusion SEQ ID NO:49 DNA sequence of the LC/A-CPBE-$H_N$/A fusion SEQ ID NO:50 Protein sequence of the LC/A-CPBE-$H_N$/A fusion SEQ ID NO:51 DNA sequence of the LC/A-CPNv-$H_N$/A fusion SEQ ID NO:52 Protein sequence of the LC/A-CPNv-$H_N$/A fusion SEQ ID NO:53 DNA sequence of the LC/A-CPN[1-11]-HN/A fusion SEQ ID NO:54 Protein sequence of the LC/A-CPN[1-11]-HN/A fusion SEQ ID NO:55 DNA sequence of the LC/A-CPN[[Y10]1-11]-HN/A fusion SEQ ID NO:56 Protein sequence of the LC/A-CPN[[Y10]1-11]-HN/A fusion SEQ ID NO:57 DNA sequence of the LC/A-CPN[[Y11]1-11]-HN/A fusion SEQ ID NO:58 Protein sequence of the LC/A-CPN[[Y11]1-11]-HN/A fusion SEQ ID NO:59 DNA sequence of the LC/A-CPN[[Y14]1-17]-HN/A fusion SEQ ID NO:60 Protein sequence of the LC/A-CPN[[Y14]1-17]-HN/A fusion SEQ ID NO:61 DNA sequence of the LC/A-CPN[1-13]-HN/A fusion SEQ ID NO:62 Protein sequence of the LC/A-CPN[1-13]-HN/A fusion SEQ ID NO:63 DNA sequence of the nociceptin-spacer-LC/A-$H_N$/A fusion SEQ ID NO:64 Protein sequence of the nociceptin-spacer-LC/A-$H_N$/A fusion SEQ ID NO:65 DNA sequence of the CPN-A GS10 linker SEQ ID NO:66 DNA sequence of the CPN-A GS15 linker SEQ ID NO:67 DNA sequence of the CPN-A GS25 linker SEQ ID NO:68 DNA sequence of the CPN-A GS30 linker SEQ ID NO:69 DNA sequence of the CPN-A HX27 linker SEQ ID NO:70 DNA sequence of the LC/A-CPN(GS15)-$H_N$/A fusion SEQ ID NO:71 Protein sequence of the LC/A-CPN(GS15)-$H_N$/A fusion SEQ ID NO:72 DNA sequence of the LC/A-CPN(GS25)-$H_N$/A fusion SEQ ID NO:73 Protein sequence of the LC/A-CPN(GS25)-$H_N$/A fusion SEQ ID NO:74 DNA sequence of the CPNvar-A Enterokinase activatable linker SEQ ID NO:75 DNA sequence of the LC/A-CPNv(Ek)-$H_N$/A fusion SEQ ID NO:76 Protein sequence of the LC/A-CPNv(Ek)-$H_N$/A fusion SEQ ID NO:77 DNA sequence of the CPNvar-A linker SEQ ID NO:78 DNA sequence of the LC/C-CPNv-$H_N$/C fusion (act. A)

SEQ ID NO:79 Protein sequence of the LC/C-CPNv-$H_N$/C fusion (act. A)

SEQ ID NO:80 DNA sequence of the LC/A-CPLE-$H_N$/A fusion

SEQ ID NO:81 Protein sequence of the LC/A-CPLE-$H_N$/A fusion

SEQ ID NO:82 DNA sequence of the LC/A-CPOP-$H_N$/A fusion

SEQ ID NO:83 Protein sequence of the LC/A-CPOP-$H_N$/A fusion

SEQ ID NO:84 DNA sequence of the LC/A-CPOPv-$H_N$/A fusion

SEQ ID NO:85 Protein sequence of the LC/A-CPOPv-$H_N$/A fusion

SEQ ID NO:86 DNA sequence of the IgA protease

SEQ ID NO:87 DNA sequence of the IgA-CPNv-$H_N$/A fusion

SEQ ID NO:88 Protein sequence of the IgA-CPNv-$H_N$/A fusion

SEQ ID NO:89 DNA sequence of the FXa-HT

SEQ ID NO:90 DNA sequence of the CPNv-A-FXa-HT

SEQ ID NO:91 Protein sequence of the CPNv-A-FXa-HT fusion

SEQ ID NO:92 DNA sequence of the DT translocation domain

SEQ ID NO:93 DNA sequence of the CPLE-DT-A

SEQ ID NO:94 Protein sequence of the CPLE-DT-A fusion

SEQ ID NO:95 DNA sequence of the TeNT LC

SEQ ID NO:96 DNA sequence of the CPNv-TENT LC

SEQ ID NO:97 Protein sequence of the CPNV-TeNT LC fusion

SEQ ID NO:98 DNA sequence of the CPNvar-C linker

SEQ ID NO:99 DNA sequence of the LC/C-CPNv-$H_N$/C fusion (act. C)

SEQ ID NO:100 Protein sequence of the LC/C-CPNv-$H_N$/C fusion (act. C)

SEQ ID NO:101 Protein sequence of dynorphin

SEQ ID NO:102 DNA sequence of LC/A-CPDY-HN/A fusion

SEQ ID NO:103 Protein sequence of LC/A-CPDY-HN/A fusion

SEQ ID NO:104 Protein sequence of LC/A-CPDY(GS10)-$H_N$/A fusion

SEQ ID NO:105 Protein sequence of LC/A-CPDY(GS15)-$H_N$/A fusion

SEQ ID NO:106 Protein sequence of LC/A-CPDY(GS25)-$H_N$/A fusion

SEQ ID NO:107 Protein sequence of LC/C-CPDY-HN/C fusion

SEQ ID NO:108 Protein sequence of IgA-CPDY-HN/A fusion

SEQ ID NO:109 Protein sequence of CPDY-TeNT LC fusion

SEQ ID NO:110 Protein sequence of LC/A-CPDY-$H_N$/A (GS30) fusion

SEQ ID NO:111 Protein sequence of LC/A-CPDY-$H_N$/A (HX27) fusion

SEQ ID NO:112 Protein sequence of LC/B-CPDY-$H_N$/B fusion

SEQ ID NO:113 Protein sequence of LC/A-CPDY1-13-$H_N$/A fusion

SEQ ID NO:114 Protein sequence of LC/A-CPDY(D15A)-$H_N$/A fusion

SEQ ID NO:115 Protein sequence of LC/A-CPDY(D15A)-$H_N$/A (GS30) fusion
SEQ ID NO:116 Protein sequence of LC/A-CPDY1-13-$H_N$/A (GS30) fusion
SEQ ID NO:117 Protein sequence of LC/A-CPDY (I8RP10RD15A)-$H_N$/A fusion
SEQ ID NO:118 Protein sequence of LC/A-CPDY (I8RP10R)1-13-$H_N$/A fusion
SEQ ID NO:119 Protein sequence of LC/A-CPDNv9-$H_N$/A fusion
SEQ ID NO:120 Protein sequence of BAM1-22
SEQ ID NO:121 Protein sequence of BAMS-22
SEQ ID NO:122 DNA sequence of LC/A-CPBAM(1-22)-$H_N$/A fusion
SEQ ID NO:123 Protein sequence of LC/A-CPBAM(1-22)-$H_N$/A fusion
SEQ ID NO:124 Protein sequence of LC/A-$H_N$/A-BAM(8-22)-$H_N$/A fusion
SEQ ID NO:125 Protein sequence of LC/A-CPBAM(8-22)-$H_N$/A fusion
SEQ ID NO:126 Protein sequence of β-endorphin
SEQ ID NO:127 Protein sequence of LC/D-CPBE-$H_N$/D fusion
SEQ ID NO:128 Protein sequence of LC/B-CPBE-$H_N$/B fusion
SEQ ID NO:129 Protein sequence of bradykinin
SEQ ID NO:130 Protein sequence of des $Arg^9$-BK
SEQ ID NO:131 DNA sequence of LC/A-$H_N$/A-BK fusion
SEQ ID NO:132 Protein sequence of LC/A-$H_N$/A-BK fusion
SEQ ID NO:133 Protein sequence of LC/A-$H_N$/A-des $Arg^9$-BK fusion
SEQ ID NO:134 Protein sequence of Substance P
SEQ ID NO:135 Protein sequence of Substance P analogue (S60)
SEQ ID NO:136 Protein sequence of LC/A-HN/A-S6 fusion
SEQ ID NO:137 Protein sequence of LC/B-CPNv-$H_N$/B fusion
SEQ ID NO:138 Protein sequence of LC/D-CPNv-$H_N$D fusion[
SEQ ID NO:139 DNA sequence of LC/D
SEQ ID NO:140 DNA sequence of $H_N$/D
SEQ ID NO:141 Protein sequence of LHA-EN-CPDNv9
SEQ ID NO:142 Protein sequence of LHA-CPOPv
SEQ ID NO:143 Protein sequence of LHA-EN-CPNv
SEQ ID NO:144 Protein sequence of LHA-Xa-GS-BA-ss
SEQ ID NO:145 Protein sequence of LHA-EK-CPBAM8-22-GS20-HnA-HT
SEQ ID NO:146 Protein sequence of LHA-EK-CPBAM1-22-GS20-HnA-HT
SEQ ID NO:147 Protein sequence of LHA-Xa-CPBE-HT
SEQ ID NO:148 Protein sequence of LHA-Xa-CPBE-HT
SEQ ID NO:149 Protein sequence of LHB-Xa-CPBE-HT
SEQ ID NO:150 Protein sequence of LHD-Xa-CPBE-HT
SEQ ID NO:151 Protein sequence of LHA-BK
SEQ ID NO:152 Protein sequence of LHA-EN-CPDY-HT
SEQ ID NO:153 Protein sequence of LHA-EN-CPDY1-13-GS20-HT
SEQ ID NO:154 Protein sequence of LHA-EN-CPDY-GS30-HT
SEQ ID NO:155 Protein sequence of LHA-EN-CPDY13-GS30-HT
SEQ ID NO:156 Protein sequence of LHA-EN-CPDY (D15A)-GS20-HT
SEQ ID NO:157 Protein sequence of LHA-EN-CPDY (D15A)-GS30-HT
SEQ ID NO:158 Protein sequence of LHB-EN-CPDY-HT
SEQ ID NO:159 Protein sequence of LHA-EN-CPDYI8RP10RD15A-GS20-HT
SEQ ID NO:160 Protein sequence of LHA-EN-CPDY (I8RP10R)1-13-GS20-HT
SEQ ID NO:161 Protein sequence of LHA-EN-CPDY-HX27-HT
SEQ ID NO:162 Protein sequence of LHA-EN-CPDNv9-HT
SEQ ID NO:163 Protein sequence of LHA-Xa-CPNv-HT
SEQ ID NO:164 Protein sequence of LHC-Xa-CPNv-HT
SEQ ID NO:165 Protein sequence of LHD-EN-CPNv-HT
SEQ ID NO:166 Protein sequence of LHA-Xa-CPN-HT
SEQ ID NO:167 Protein sequence of LHB-EN-CPNv-HT
SEQ ID NO:168 Protein sequence of LHA-CPOPv-HT
SEQ ID NO:169 Protein sequence of LHA-Xa-GS-S6-ss

EXAMPLES

Example 1

Confirmation of TM Agonist Activity by Measuring Release of Substance P from Neuronal Cell Cultures Materials Substance P EIA is obtained from R&D Systems, UK.

Methods

Primary neuronal cultures of eDRG are established as described previously (Duggan et al., 2002). Substance P release from the cultures is assessed by EIA, essentially as described previously (Duggan et al., 2002). The TM of interest is added to the neuronal cultures (established for at least 2 weeks prior to treatment); control cultures are performed in parallel by addition of vehicle in place of TM. Stimulated (100 mM KCl) and basal release, together with total cell lysate content, of substance P are obtained for both control and TM treated cultures. Substance P immunoreactivity is measured using to Substance P Enzyme Immunoassay Kits (Cayman Chemical Company, USA or R&D Systems, UK) according to manufacturers' instructions.

The amount of Substance P released by the neuronal cells in the presence of the TM of interest is compared to the release obtained in the presence and absence of 100 mM KCl. Stimulation of Substance P release by the TM of interest above the basal release, establishes that the TM of interest is an "agonist ligand" as defined in this specification. If desired the stimulation of Substance P release by the TM of interest can be compared to a standard Substance P release-curve produced using the natural ORL-1 receptor ligand, nociceptin (Tocris).

Example 2

Expression and Purification of Catalytically Active $LH_N$/A

Materials

Synthetic DNA obtained from Sigma Genosys.

Restriction enzymes obtained from New England Biolabs.

Methods

The expression and purification of catalytically active $LH_N$/A was carried out essentially as described in Sutton et al., (2005), Prot. Express. Purif., 40, pp 31-41.

Briefly, DNA encoding the light chain plus 423 amino acids from the N-terminal of the heavy chain of BoNT/A was synthesised by Sigma-Genosys to produce a synthetic $LH_N$/A gene with an *E. coli* codon bias. The linker region between the light chain and $H_N$ domain was engineered to contain a Factor Xa cleavage site by splice-overlap extension PCR. Two PCR products were generated using primer pairs consisting of a long, mutagenic primer and a shorter, non-mutagenic primer:

```
(5'-tccaaaactaaatctctgATAGAAGGTAGAaacaaagcgctgaacgac; SEQ ID NO: 176)
with

(5'-CTTGATGTACTCTGTGAACGTGCTC; SEQ ID NO: 177);
and

(5'-gtcgttcagcgctttgttTCTACCTTCTATcagagatttagttttgga; SEQ ID NO: 178)
with

(5'-ATGGAGTTCGTTAACAAACAGTTC; SEQ ID NO: 179).
```

The products from these two reactions were used as templates for the splice-overlap extension PCR. A further PCR reaction was set up to add BamHI and SalI sites at either end of the activatable recLH$_N$/A gene and these sites were used for insertion into an Invitrogen gateway entry vector. The entry vector was then used, along with a gateway recombination site adapted pMAL c2x, in a LR clonase reaction to form pMAL c2x recLH$_N$/A. The pMAL c2x recLH$_N$/A was modified to incorporate a 6'HIS tag at the N-terminus of the MBP. This was achieved by the insertion of annealed oligonucleotides encoding the HIS tag into the NdeI site of pMAL.

The expression vector expressing LH$_N$/A was transformed into *E. coli* HMS174 or AD494 (DE3) (Novagen). Cultures were grown in Terrific broth complex medium supplemented with ZnCl$_2$ (1 µM), ampicillin (100 µg/ml), 0.2% (w/v) glucose. Parameters for expression of all the constructs were initially determined in shake flask cultures before transferring into 8 L fermentor systems. Starter cultures were grown for 16 hours at 37° C., 220 rpm and used to inoculate 1 L in which growth was continued at 37° C., 250 rpm. At an OD600 nm of 0.6 the temperature was reduced to 25° C. for 30 minutes before induction with 1 mM IPTG. Induction was continued for 4 hours before the cells were harvested and stored at −70° C.

Typically 16 g of cell paste was suspended in 160 ml PBS and lysed by sonication (MSE Soniprep 150). The resulting lysate was clarified by centrifugation prior loading onto a 25 ml amylose column and eluted with 10 mM maltose in PBS. The eluant contained approx. 50% pure fusion protein and was treated with Factor Xa (1 unit Factor Xa/100 µg fusion protein; 20 hours; 26° C.) to remove the HISMBP and cleave the LC-H$_N$ junction to activate the protein. After incubation the sample was filtered (0.45 mm) and diluted two fold with water to give a 0.5×PBS buffer composition. The cleaved, filtered and diluted recLH$_N$/A was processed through a Q Sepharose FF column (10 ml) and eluted with a step gradient of 80 mM NaCl containing HISMBP and 120 mM NaCl containing approx. 75% pure recLH$_N$/A. The addition of His tag to MBP overcame previous co-elution problems with LH$_N$/A and MBP. As a final polishing step to ensure complete removal of the HISMBP, the 120 mM NaCl elution from the Q Sepharose column was passed through a Nickel charged 5 ml HisTrap column (Amersham). The flow through from the HisTrap column contained approx. 95% pure recLH$_N$/A (see the Figures in Sutton et al., (2005), Prot. Express. Purif., 40, pp 31-41 for an illustration of the purification scheme for LHN/A).

Example 3

Expression and Purification of Catalytically Active Recombinant LH$_N$/B

The methodology described below will purify catalytically active LH$_N$/B protease from *E. coli* transformed with the appropriate plasmid encoding the LH$_N$/B polypeptide. It should be noted that various sequences of suitable LH$_N$/B polypeptides have been described in PCT/GB97/02273, granted U.S. Pat. No. 6,461,617 and U.S. patent application Ser. No. 10/241,596, incorporated herein by reference.

Methods

The coding region for LH$_N$/B is inserted in-frame to the 3' of the gene encoding maltose binding protein (MBP) in the expression vector pMAL (New England Biolabs) to create pMAL-c2x-LH$_N$/B. In this construct, the expressed MBP and LH$_N$/B polypeptides are separated by a Factor Xa cleavage site, and the LC and H$_N$ domains are separated by a peptide that is susceptible to cleavage with enterokinase. The expression clone is termed pMAL-c2X-synLH$_N$/B.

pMAL-c2X-synLH$_N$/B is transformed into *E. coli* HMS174 and cultured in Terrific broth complex medium in 8 L fermentor systems. Pre-induction bacterial growth is maintained at 37° C. to an OD600 nm of 5.0, at which stage expression of recMBP-LH$_N$/B is induced by addition of IPTG to 0.5 mM and a reduction in temperature to 30° C. After four hours at 30° C. the bacteria are harvested by centrifugation and the resulting paste stored at −70° C.

The cell paste is resuspended in 20 mM Hepes pH 7.2, 125 mM NaCl, 1 µM ZnCl$_2$ and cell disruption achieved using an APV-Gaulin lab model 1000 homogeniser or a MSE Soniprep 150 sonicator. The resulting suspension is clarified by centrifugation prior to purification.

Following cell disruption, the MBP-fusion protein is captured either on an amylose affinity resin in 20 mM Hepes pH 7.2, 125 mM NaCl, 1 µM ZnCl$_2$, or on a Q-Sepharose FF anion-exchange resin in 50 mM Hepes pH 7.2, 1 µM ZnCl$_2$ with no salt. A single peak is eluted from the amylose resin in the same buffer plus 10 mM maltose and from the Q-Sepharose in 150-200 mM salt. Cleavage of the MBP-LH$_N$/B junction is completed in an 18 hours incubation step at 22° C. with Factor Xa (NEB) at 1 U/50 µg fusion protein. A substrate (MBP-LH$_N$/B) concentration of at least 4 mg/ml is desirable is for efficient cleavage to take place.

Figure 1:
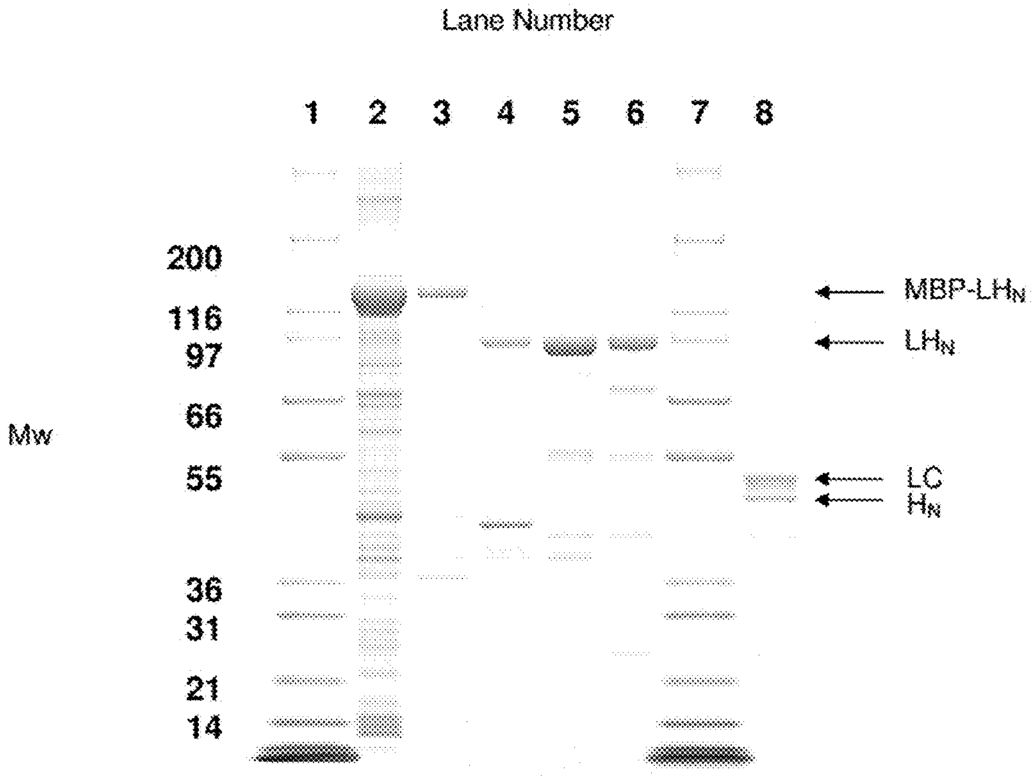
FIG. 1—Expression and Purification of recLH$_N$/B Fusion Protein

The cleaved protein is diluted with 20 mM Hepes to a buffer composition of 20 mM Hepes, 25 mM NaCl, 1 µM ZnCl$_2$, pH 7.2 and processed through a Q Sepharose column to separate the MBP from LH$_N$/B. The LH$_N$/B is eluted from the Q-Sepharose column with 120-170 mM salt. The linker between the light chain and H$_N$ domain is then nicked by incubation with enterokinase at 1 U/100 µg of LH$_N$/B at 22° C. for 16 hours. Finally, the enterokinase is separated from the nicked LH$_N$/B and other contaminating proteins on a Benzamidine Sepharose column, the enzyme preferentially binding to the resin over an incubation of 30 minutes at 4° C. Purified LH$_N$/B is stored at −20° C. until required. See FIG. 1 for an illustration of the purification scheme for recLH$_N$/B.

Example 4

Expression and Purification of Catalytically Active Recombinant LH$_N$/C

The coding region for LH$_N$/C is inserted in-frame to the 3' of the gene encoding maltose binding protein (MBP) in the expression vector pMAL (New England Biolabs) to create pMAL-c2x-$LH_N$/C. In this construct the expressed MBP and $LH_N$/C polypeptides are separated by a Factor Xa cleavage site.

pMAL-c2x-$LH_N$/C is transformed into *E. coli* AD494 (DE3, IRL) and cultured in Terrific broth complex medium in 8 L fermentor systems. Pre-induction bacterial growth are maintained at 30° C. to an OD600 nm of 8.0, at which stage expression of recMBP-c2x-$LH_N$/C is induced by addition of IPTG to 0.5 mM and a reduction in temperature of culture to 25° C. After 4 hours at 25° C. the bacteria are harvested by centrifugation and the resulting paste stored at −70° C.

The cell paste is resuspended in 50 mM Hepes pH 7.2, 1 μM $ZnCl_2$ at 1:6 (w/v) and cell disruption is achieved using an APV-Gaulin lab model 1000 homogeniser or a MSE Soniprep 150 sonicator. The resulting suspension is clarified by centrifugation prior to purification.

Figure 2:
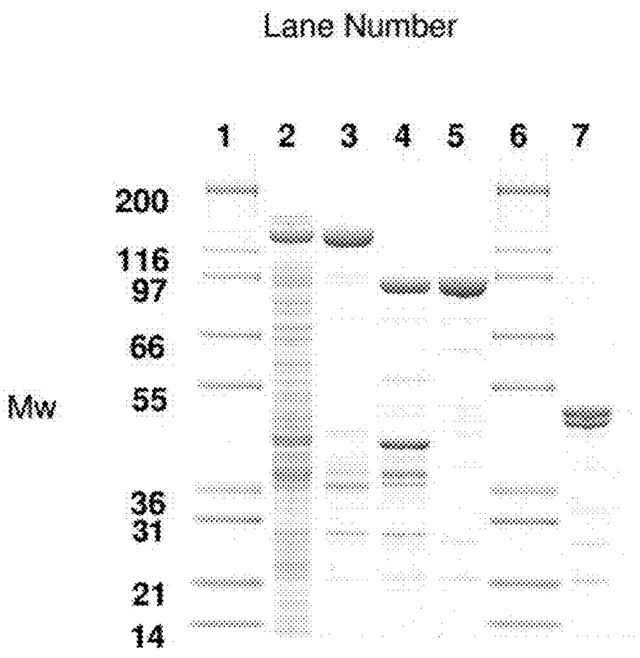
FIG. 2—Expression and Purification of LH$_N$/C Fusion Protein

Following cell disruption and clarification, the MBP-fusion protein is separated on a Q-Sepharose Fast Flow anion-exchange resin in 50 mM Hepes pH 7.2, 1 μM $ZnCl_2$ and eluted with the same buffer plus 100 mM NaCl. A double point cleavage is performed at the MBP-$LH_N$/C junction and the $H_N$-LC linker in a single incubation step with Factor Xa. The reaction is completed in a 16-hour incubation step at 22° C. with Factor Xa (NEB) at 1 U/100 ìg fusion protein. The cleaved protein is diluted with 20 mM Hepes to a buffer composition of 20 mM Hepes, 25 mM NaCl, pH 7.2 and processed through a second Q-Sepharose column to separate the MBP from $LH_N$/C. Activated (disulphide-bonded cleaved linker) $LH_N$/C is eluted from the Q-Sepharose column by a salt gradient (20 mM Hepes, 500 mM NaCl, 1 μM $ZnCl_2$, pH 7.2) in 120-170 mM salt. See FIG. 2 for an illustration of the purification of $LH_N$/C.

Example 5

Production of a Chemical Conjugate of Nociceptin and $LH_N$/A

Materials

C-terminally extended nociceptin peptide obtained from Sigma Genosys. Conjugation chemicals obtained from Pierce.

Methods

In order to couple the nociceptin peptide via a C-terminal Cys, the peptide was first synthesised (by standard procedures, commercially obtainable) to include a Cys as the final C-terminal amino acid.

This peptide was then used as the second component in a sulphydryl based coupling reaction as described below (see also previous publications WO 99/17806 and WO 96/33273 and Duggan et al., (2002), J. Biol. Chem. 277, 24846-34852 and Chaddock et al., (2000), Infect Immun., 68, 2587-2593).

Sulphydryl Based Coupling Reaction

Briefly, approximately two reactive leaving groups were introduced into $LH_N$/A (5 mg/ml in phosphate-buffered saline) by reaction with N-succinimidyl-3-(2-pyridyldithio) propionate (SPDP).

Derivatised material was isolated from excess SPDP by size exclusion chromatography. Reconstituted cysteine-tagged nociceptin ligand was mixed with the derivatised $LH_N$/A in a 4:1 molar ratio, and incubated at room temperature for 1 hour with gentle agitation is in order to create a chemical conjugate through a reducible covalent disulphide bond.

Initial fractionation of the conjugate mixture to remove unconjugated peptide was performed by size exclusion chromatography (Superose-12, or Superdex G-200 depending on scale of conjugation).

Example 6

Production of a Chemical Conjugate of Nociceptin and $LH_N$/B

Materials

C-terminally extended nociceptin peptide obtained from Sigma Genosys.

Conjugation chemicals obtained from Pierce.

Methods

Lyophilised nociceptin was dissolved by the addition of water and dialysed into MES buffer (0.1 M MES, 0.1 M NaCl, pH 5.0). To this solution (at a concentration of about 0.3 mg/ml) was added PDPH (100 mg/ml in DMF) to a final concentration of 1 mg/ml. After mixing, solid EDAC was added to produce a final concentration of about 0.2 mg/ml. The reaction was allowed to proceed for at least 30 minutes at room temperature. Excess PDPH was then removed by desalting over a PD-10 column (Pharmacia) previously equilibrated with MES buffer.

An amount of $LH_N$/B equivalent to half the weight of nociceptin used dissolved in triethanolamine buffer (0.02 M triethanolamine/HCl, 0.1 M sodium chloride, pH 7.8) at a concentration of about 1 mg/ml, was reacted with Traut's reagent (100 mM stock solution in 1 M triethanolamine/HCl, pH 8.0) at a final concentration of 2 mM. After 1 hour, the $LH_N$/B was desalted into PBSE (phosphate buffered saline with 1 mM EDTA) using a PD-10 column (Pharmacia). The protein peak from the column eluate was concentrated using a Microcon 50 (Amicon) to a concentration of about 2 mg/ml.

The derivatised nociceptin was subjected to a final concentration step resulting in a reduction in volume to less than 10% of the starting volume and then mixed with the derivatised $LH_N$/B overnight at room temperature. The products of the reaction were analysed by polyacrylamide gel electrophoresis in the presence of sodium dodecyl-sulphate (SDS-PAGE).

The conjugate resulting from the above reaction was partially purified by size exclusion chromatography over Bio-Gel P-100 (BioRad). The elution profile was followed by measuring the optical density at 280 nm and SDS-PAGE analysis of the fractions. This allowed the separation of conjugate from free nociceptin and by-products of the reaction.

Example 7

Production of a Chemical Conjugate of Nociceptin 1-11 and $LH_N$/B

Materials

C-terminally extended nociceptin 1-11 peptide obtained from Sigma Genosys.

Conjugation chemicals obtained from Pierce.

Methods

In order to couple the nociceptin 1-11 peptide via a C-terminal Cys, the peptide was first synthesised (by standard procedures, commercially obtainable) to include a Cys as the final C-terminal amino acid.

This peptide was then used as the second component in a sulphydryl based coupling reaction as described in Example 5.

Example 8

Production of a Chemical Conjugate of Nociceptin N[[Y14]1-17] and $LH_N$/C

Materials

C-terminally extended nociceptin N[[Y14]1-17] peptide obtained from Sigma Genosys. Conjugation chemicals obtained from Pierce.

Methods

In order to couple the peptide via a C-terminal Cys, the peptide was first synthesised (by to standard procedures, commercially obtainable) to include a Cys as the final C-terminal amino acid.

This peptide was then used as the second component in a sulphydryl based coupling reaction as described in Example 5.

Example 9

Recombinant Production of a Single Polypeptide Fusion of Nociceptin-$LH_N$/A (SEQ ID NO:15 and SEQ ID NO:16)

The DNA sequence for the nociceptin-$LH_N$/A was designed by back translation of the LC/A, $H_N$/A, and nociceptin amino acid sequences. The complete ORF containing the nociceptin-LC/A-activation loop-$H_N$/A sequence was assembled within standard DNA sequence manipulation software (EditSeq). The activation loop between the LC/A cysteine and the $H_N$/A cysteine (CVRGIITSKTKSLDKGYNKALNDLC; SEQ ID NO:180) was modified to incorporate a Factor Xa protease recognition site.

Restriction sites appropriate to facilitate cloning into the required expression vector (for example BamHI/SalI) were incorporated at the 5' and 3' ends respectively of the sequence maintaining the correct reading frame. The DNA sequence was screened (using software such as MapDraw, DNASTAR Inc.) for restriction enzyme cleavage sequences incorporated during the back translation. Any cleavage sequences that were found to be common to those required by the cloning system were removed manually from the proposed coding sequence ensuring common *E. coli* codon usage was maintained. *E. coli* codon usage was assessed by reference to software programs such as Graphical Codon Usage Analyser (Geneart), and the % GC content and codon usage ratio assessed by reference to published codon usage tables (for example GenBank Release 143, 13 Sep. 2004).

This optimised DNA sequence containing the nociceptin-LC/A-activation loop-$H_N$/A open reading frame (ORF) was then commercially synthesized and provided in the pCR 4 vector.

The DNA encoding the nociceptin-$LH_N$/A fusion was isolated from pCR 4 and transferred into pMAL vector backbone to facilitate protein expression. The resultant pMAL NO-LHN/A vector was transformed into competent *E. coli* BL21 and correct transformants selected. A single colony of pMAL NO-$LH_N$/A was grown in Terrific broth complex medium supplemented with $ZnCl_2$ (1 mM), ampicillin (100 µg/ml), 0.2% (w/v) glucose. Expression of the insert was induced by the addition of IPTG (0.1 mM) and the culture maintained at 16° C. for 16 hours. After this period of expression the bacteria were isolated by centrifugation and the cell pellet stored at −20° C. until use.

10 g of *E. coli* BL21 cell paste was defrosted in a falcon tube containing 25 ml 50 mM HEPES, pH 7.2, 200 mM NaCl. The thawed cell paste was made up to 80 ml with 50 mM HEPES, pH 7.2, 200 mM NaCl and sonicated on ice 30 seconds on, 30 seconds off for 10 cycles at a power of 22 microns ensuring the sample remained cool. The lysed cells were centrifuged at 18 000 rpm, 4° C. for 30 minutes. The supernatant was loaded onto a 0.1 M $NiSO_4$ charged chelating column (20-30 ml column is sufficient) and equilibrated with 50 mM HEPES, pH 7.2, 200 mM NaCl.

Using a step gradient of 10 and 40 mM imidazol, the non-specific bound protein was washed away and the fusion protein eluted with 100 mM imidazol. The eluted fusion protein was dialysed against 5 L of 50 mM HEPES, pH 7.2, 200 mM NaCl at 4° C. overnight and the OD of the dialysed fusion protein measured. 1 unit of Factor Xa was added per 100 µg fusion protein and incubated at 25° C. static overnight. The cleavage mixture was loaded onto a 0.1 M $NiSO_4$ charged Chelating column (20-30 ml column is sufficient) and equilibrated with 50 mM HEPES, pH 7.2, 200 mM NaCl.

Using a step gradient of 10 and 40 mM imidazol, the non-specific bound protein was washed away and the fusion protein eluted with 100 mM imidazol. The eluted fusion protein was dialysed against 5 L of 50 mM HEPES, pH 7.2, 200 mM NaCl at 4° C. overnight and the fusion concentrated to about 2 mg/ml, aliquoted and stored at −20° C.

Figure 3:
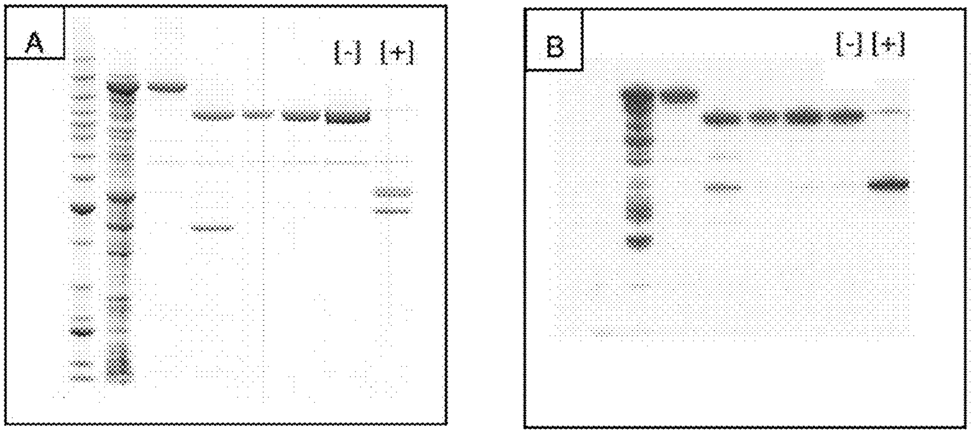
FIG. 3—Expression and Purification of N[1-17]-LH$_N$/A Fusion Protein
Figure 4:
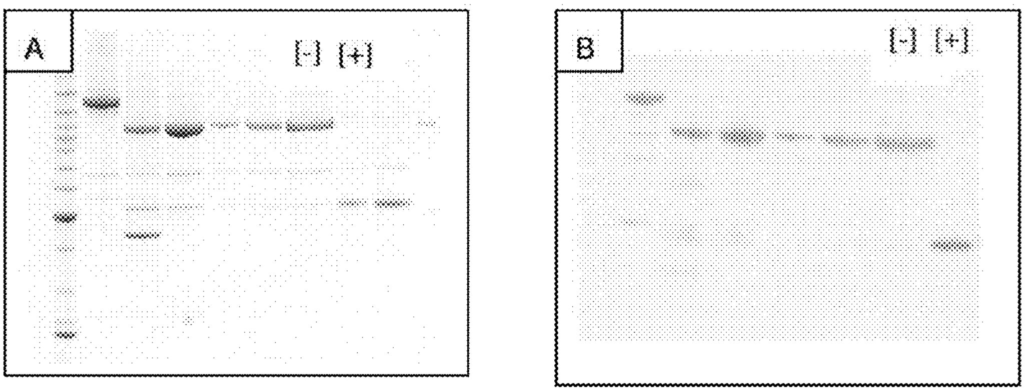
FIG. 4—Purification of a LC/A-Nociceptin-H$_N$/A Fusion Protein

FIG. 3 shows the SDS-PAGE analysis of expression and purification of N[1-17]-$LH_N$/A Example 10

Recombinant Production of a Single Polypeptide Fusion of (Nociceptin 1-11)-$LH_N$/B The DNA sequence for the (nociceptin 1-11)-$LH_N$/B was designed by back translation of the LC/B, $H_N$/B, and nociceptin 1-11 amino acid sequences. The complete ORF containing the (nociceptin1-11)-LC/B-activation loop-$H_N$/B sequence was assembled within standard DNA sequence manipulation software (EditSeq). The activation loop is between the LC/B cysteine and the $H_N$/B cysteine was modified to incorporate a Factor Xa protease recognition site.

The recombinant fusion protein was then produced essentially as described in Example 9.

Example 11

Recombinant Production of a Single Polypeptide Fusion of (Nociceptin N[[Y14]1-17])-$LH_N$/C (SEQ ID NO:25 and SEQ ID NO:26)

The DNA sequence for the nociceptin N[[Y14]1-17] was designed by back translation of the LC/C, $H_N$/C, and nociceptin N[[Y14]1-17] amino acid sequences. The complete ORF containing the (nociceptin N[[Y14]1-17])-LC/C-activation loop-$H_N$/C sequence was assembled within standard DNA sequence manipulation software (EditSeq). The activation loop between the LC/C cysteine and the $H_N$/C cysteine was modified to incorporate a Factor Xa protease recognition site.

The recombinant fusion protein was then produced essentially as described in Example 9.

Example 12

Recombinant Production of a Single Polypeptide Fusion of $LH_N$/C-(Nociceptin 1-11) (SEQ ID NO:23 and SEQ ID NO:24)

The DNA sequence for the $LH_N$/C-(nociceptin 1-11) was designed by back translation of the LC/C, $H_N$/C and nociceptin 1-11 amino acid sequences. The complete ORF (SEQ ID NO:23) containing the LC/C-activation loop-$H_N$/C-flexible spacer-(nociceptin 1-11) was assembled within standard DNA sequence manipulation software (EditSeq).

The recombinant fusion protein (SEQ ID NO:24) was then produced essentially as described in Example 9.

Example 13

Production of a Conjugate for Delivery of DNA encoding LC/C into a Cell

The construction of a nociceptin-$H_N$-[LC/C] conjugate is described below, where [LC/C] represents the polylysine condensed DNA encoding the light chain of botulinum neurotoxin type C.

Materials

SPDP is from Pierce Chemical Co.

Additional reagents are obtained from Sigma Ltd.

Methods

Using a plasmid containing the gene encoding LC/C under the control of a CMV (immediate early) promoter, condensation of DNA was achieved using SPDP-derivatised polylysine to a ratio of 2 DNA to 1 polylysine. Conjugates were then prepared by mixing condensed DNA (0.4 mg/ml) with $H_N$-nociceptin (100 µg/ml) for 16 h at 25° C. The SPDP-derivatised polylysine and the free —SH group present on the $H_N$ domain combine to facilitate covalent attachment of the DNA and protein.

Example 14

Production of a Conjugate for Delivery of DNA Encoding LC/B into a Cell

The construction of a (nociceptin 1-11)-$H_N$-[LC/B] conjugate is described below, where [LC/B] represents the polylysine condensed DNA encoding the light chain of botulinum neurotoxin type B.

Materials

SPDP is from Pierce Chemical Co.

Additional reagents are obtained from Sigma Ltd.

Methods

Using a plasmid containing the gene encoding LC/B under the control of a CMV (immediate early) promoter, condensation of DNA was achieved using SPDP-derivatised polylysine to a ratio of 2 DNA to 1 polylysine. Conjugates were then prepared by mixing condensed DNA (0.4 mg/ml) with $H_N$-(nociceptin 1-11) (100 µg/ml) for 16 h at 25° C. The SPDP-derivatised polylysine and the free —SH group present on the $H_N$ domain combine to facilitate covalent attachment of the DNA and protein.

Example 15

Assessment of the Activity of Nociceptin-$LH_N$/A in Substance P Releasing Neuronal Cells Using methodology described in Duggan et al., (2002, J. Biol. Chem., 277, 34846-34852), the activity of nociceptin-$LH_N$/A in substance P releasing neuronal cells was assessed.

Nociceptin-$LH_N$/A fusion protein was applied to 2-week old dorsal root ganglia neuronal cultures, and incubated at 37° C. for 16 hours. Following the incubation, the media was removed and the ability of the cells to undergo stimulated release of substance P(SP) was assessed.

The release of SP from the neuronal cells incubated with the nociceptin-$LH_N$/A fusion protein was assayed in comparison to (i) $LH_N$/A-only treated cells and (ii) cells treated with media alone. This allowed the % inhibition of substance P from the eDRG to be calculated. The ability of the nociceptin-$LH_N$/A fusion protein to inhibit SP release (relative to cells treated with media alone) was reported in Table 1. The data represent the mean of 3 determinations:

TABLE 1

| Test Material (µM) | Nociceptin-$LH_N$/A fusion protein % Inhibition | $LH_N$/A-only % Inhibition |
|---|---|---|
| 1.0 | 47.3 | 25.6 |
| 0.1 | 13.8 | −11.5 |

Example 16

Confirmation of $ORL_1$ Receptor Activation by Measuring Forskolin-Stimulated cAMP Production Confirmation that a given TM is acting via the $ORL_1$ receptor is provided by the following test, in which the TMs ability to inhibit forskolin-stimulated cAMP production is assessed.

Materials

[$^3$H]adenine and [$^{14}$C]cAMP are obtained from GE Healthcare

Methods

The test is conducted essentially as described previously by Meunier et al. [Isolation and structure of the endogenous agonist of opioid receptor-like $ORL_1$ receptor. Nature 377: 532-535, 1995] in intact transfected-CHO cells plated on 24-well plastic plates.

To the cells is added [3H]adenine (1.0 µCi) in 0.4 ml of culture medium. The cells remain at 37° C. for 2 h to allow the adenine to incorporate into the intracellular ATP pool. After 2 h, the cells are washed once with incubation buffer containing: 130 mM NaCl, 4.8 mM KCl, 1.2 mM $KH_2PO_4$, 1.3 mM $CaCl_2$, 1.2 mM $MgSO_4$, 10 mM glucose, 1 mg/ml bovine serum albumin and 25 mM HEPES, pH 7.4, and replaced with buffer containing forskolin (10 µM) and isobutylmethylxanthine (50 µM) with or without the TM of interest. After 10 min., the medium is aspirated and replaced with 0.5 ml, 0.2 M HCl. Approximately 1000 cpm of [$^{14}$C]cAMP is added to each well and used as an internal standard. The contents of the wells are then transferred to columns of 0.65 g dry alumina powder. The columns are eluted with 4 ml of 5 mM HCl, 0.5 ml of 0.1 M ammonium acetate, then two additional millilitres of ammonium acetate. The final eluate is collected into scintillation vials and counted for $^{14}$C and tritium. Amounts collected are corrected for recovery of [$^{14}$C]cAMP. TMs that are agonists at the $ORL_1$ receptor cause a reduction in the level of cAMP produced in response to forskolin.

Example 17

Confirmation of $ORL_1$ Receptor Activation Using a GTPγS Binding Functional Assay Confirmation that a given TM is acting via the $ORL_1$ receptor is also provided by the following test, a GTPγS binding functional assay.

Materials

[$^{35}$S]GTPγS is obtained from GE Healthcare

Wheatgerm agglutinin-coated (SPA) beads are obtained from GE Healthcare

Methods

This assay is carried out essentially as described by Traynor and Nahorski [Modulation by β-opioid agonists of guanosine-5-O-(3-[$^{35}$S]thio)triphosphate binding to membranes from human neuroblastoma SH-SY5Y cells. Mol. Pharmacol. 47: 848-854, 1995].

Cells are scraped from tissue culture dishes into 20 mM HEPES, 1 mM ethylenediaminetetraacetic acid, then centrifuged at 500×g for 10 min. Cells are resuspended in this buffer and homogenized with a Polytron Homogenizer.

The homogenate is centrifuged at 27,000×g for 15 min., and the pellet resuspended in buffer A, containing: 20 mM HEPES, 10 mM $MgCl_2$, 100 mM NaCl, pH 7.4. The suspension is recentrifuged at 20,000×g and suspended once more in buffer A. For the binding assay, membranes (8-15 μg protein) are incubated with [$^{35}$S]GTP S (50 pM), GDP (10 μM), with and without the TM of interest, in a total volume of 1.0 ml, for 60 min. at 25° C. Samples are filtered over glass fibre filters and counted as described for the binding assays.

Example 18

Preparation of a LC/A and $H_N$/A Backbone Clones

The following procedure creates the LC and $H_N$ fragments for use as the component backbone for multidomain fusion expression. This example is based on preparation of a serotype A based clone (SEQ ID NO:27 and SEQ ID NO:28), though the procedures and methods are equally applicable to the other serotypes [illustrated by the sequence listing for serotype B (SEQ ID NO:29 and SEQ ID NO:30) and serotype C (SEQ ID NO:31 and SEQ ID NO:32)].

Preparation of Cloning and Expression Vectors pCR 4 (Invitrogen) is the chosen standard cloning vector, selected due to the lack of restriction sequences within the vector and adjacent sequencing primer sites for easy construct confirmation. The expression vector is based on the pMAL (NEB) expression vector, which has the desired restriction sequences within the multiple cloning site in the correct orientation for construct insertion (BamHI-SalI-PstI-HindIII). A fragment of the expression vector has been removed to create a non-mobilisable plasmid and a variety of different fusion tags have been inserted to increase purification options.

Preparation of Protease (e.g. LC/a) Insert

The LC/A (SEQ ID NO:27) is created by one of two ways:

The DNA sequence is designed by back translation of the LC/A amino acid sequence [obtained from freely available database sources such as GenBank (accession number P10845) or Swissprot (accession locus BXA1_CLOBO) using one of a variety of reverse translation software tools (for example EditSeq best *E. coli* reverse translation (DNASTAR Inc.), or Backtranslation tool v2.0 (Entelechon)]. BamHI/SalI recognition sequences are incorporated at the 5' and 3' ends respectively of the sequence, maintaining the correct reading frame. The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the LC/A open reading frame (ORF) is then commercially synthesized (for example by Entelechon, Geneart or Sigma-Genosys) and is provided in the pCR 4 vector.

The alternative method is to use PCR amplification from an existing DNA sequence with BamHI and SalI restriction enzyme sequences incorporated into the 5' and 3' PCR primers respectively. Complementary oligonucleotide primers are chemically synthesised by a supplier (for example MWG or Sigma-Genosys), so that each pair has the ability to hybridize to the opposite strands (3' ends pointing "towards" each other) flanking the stretch of *Clostridium* target DNA, one oligonucleotide for each of the two DNA strands. To generate a PCR product the pair of short oligonucleotide primers specific for the *Clostridium* DNA sequence are mixed with the *Clostridium* DNA template and other reaction components and placed in a machine (the 'PCR machine') that can change the incubation temperature of the reaction tube automatically, cycling between approximately 94° C. (for denaturation), 55° C. (for oligonucleotide annealing), and 72° C. (for synthesis). Other reagents required for amplification of a PCR product include a DNA polymerase (such as Taq or Pfu polymerase), each of the four nucleotide dNTP building blocks of DNA in equimolar amounts (50-200 μM) and a buffer appropriate for the enzyme optimised for $Mg^{2+}$ concentration (0.5-5 mM).

The amplification product is cloned into pCR 4 using either, TOPO TA cloning for Taq PCR products or Zero Blunt TOPO cloning for Pfu PCR products (both kits commercially available from Invitrogen). The resultant clone is checked by sequencing. Any additional restriction sequences which are not compatible with the cloning system are then removed using site directed mutagenesis [for example, using Quickchange (Stratagene Inc.)].

Preparation of Translocation (e.g. $H_N$) Insert

The $H_N$/A (SEQ ID NO:28) is created by one of two ways:

The DNA sequence is designed by back translation of the $H_N$/A amino acid sequence [obtained from freely available database sources such as GenBank (accession number P10845) or Swissprot (accession locus BXA1_CLOBO)] using one of a variety of reverse translation software tools [for example EditSeq best *E. coli* reverse translation (DNASTAR Inc.), or Backtranslation tool v2.0 (Entelechon)]. A PstI restriction sequence added to the N-terminus and XbaI-stop codon-HindIII to the C-terminus ensuring the correct reading frame is maintained. The DNA sequence is screened (using software such as MapDraw, DNASTAR Inc.) for restriction enzyme cleavage sequences incorporated during the back translation. Any sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The alternative method is to use PCR amplification from an existing DNA sequence with PstI and XbaI-stop codon-HindIII restriction enzyme sequences incorporated into the 5' and 3' PCR primers respectively. The PCR amplification is performed as described above. The PCR product is inserted into pCR 4 vector and checked by sequencing. Any additional restriction sequences which are not compatible with the cloning system are then removed using site directed mutagenesis [for example using Quickchange (Stratagene Inc.)].

Example 19

Preparation of a LC/A-Nociceptin-$H_N$/A Fusion Protein (Nociceptin is N-Terminal of the $H_N$-Chain)

Preparation of Linker-Nociceptin-Spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL (amino acids 2-24 of SEQ ID NO:180). Within this sequence, it is understood that proteolytic activation in nature leads to an $H_N$ domain that has an N-terminus of the sequence ALNDL. This sequence information is freely available from available database sources such as GenBank (accession number P10845) or Swissprot (accession locus BXA1_CLOBO). Into this linker a Factor Xa site, nociceptin and spacer are incorporated; and using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-nociceptin-NheI-spacer-SpeI-PstI-XbaI-stop codon-HindIII (SEQ ID NO:33). It is important to ensure the correct reading frame is maintained for the spacer, nociceptin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example by Entelechon, Geneart or Sigma-Genosys) and is provided in the pCR 4 vector.

Preparation of the LC/A-Nociceptin-$H_N$/A Fusion

In order to create the LC-linker-nociceptin-spacer-$H_N$ construct (SEQ ID NO:39), the pCR 4 vector encoding the linker (SEQ ID NO:33) is cleaved with BamHI+SalI restriction enzymes. This cleaved vector then serves as the recipient vector for insertion and ligation of the LC/A DNA (SEQ ID NO:27) cleaved with BamHI+SalI. The resulting plasmid DNA is then cleaved with PstI+XbaI restriction enzymes and serves as the recipient vector for the insertion and ligation of the $H_N$/A DNA (SEQ ID NO:28) cleaved with PstI+XbaI. The final construct contains the LC-linker-nociceptin-spacer-$H_N$ ORF (SEQ ID NO:39) for transfer into expression vectors for expression to result in a fusion protein of the sequence illustrated in SEQ ID NO:40.

Example 20

Preparation of a Nociceptin-LC/A-$H_N$/A Fusion Protein (Nociceptin is N-Terminal of the LC-Chain)

The LC/A-$H_N$/A backbone is constructed as described in Example 19 using the synthesised A serotype linker with the addition of a Factor Xa site for activation, arranged as BamHI-SalI-linker-protease site-linker-PstI-XbaI-stop codon-HindIII (SEQ ID NO:34). The LC/A-$H_N$/A backbone and the synthesised N-terminal presentation nociceptin insert (SEQ ID NO:35) are cleaved with BamHI+HindIII restriction enzymes, gel purified and ligated together to create a nociceptin-spacer-LC-linker-$H_N$. The ORF (SEQ ID NO:41) is then cut out using restriction enzymes AvaI+XbaI for transfer into expression vectors for expression to result in a fusion protein of the sequence illustrated in SEQ ID NO:42.

Example 21

Preparation of a LC/C-Nociceptin-$H_N$/C Fusion Protein

Following the methods used in Examples 1 and 2, the LC/C (SEQ ID NO:31) and $H_N$/C (SEQ ID NO:32) are created and inserted into the C serotype linker arranged as BamHI-Sail-linker-protease site-nociceptin-NheI-spacer-SpeI-PstI-XbaI-stop codon-HindIII (SEQ ID NO:36). The final construct contains the LC-linker-nociceptin-spacer-$H_N$ ORF (SEQ ID NO:43) for expression as a protein of the sequence illustrated in SEQ ID NO:44.

Example 22

Preparation of a LC/C-Nociceptin-$H_N$/C Fusion Protein with a Serotype A Activation Sequence Following the methods used in Examples 1 and 2, the LC/C (SEQ ID NO:31) and $H_N$/C (SEQ ID NO:32) are created and inserted into the A serotype linker arranged as BamHI-Sail-linker-protease site-nociceptin-NheI-spacer-SpeI-PstI-XbaI-stop codon-HindIII (SEQ ID NO:33). The final construct contains the LC-linker-nociceptin-spacer-$H_N$ ORF (SEQ ID NO:45) for expression as a protein of the sequence illustrated in SEQ ID NO:46.

Example 23

Preparation of a LC/A-Met Enkephalin-$H_N$/A Fusion Protein

Due to the small, five-amino acid, size of the met-enkephalin ligand the LC/A-met enkephalin-$H_N$/A fusion is created by site directed mutagenesis [for example using Quickchange (Stratagene Inc.)] using the LC/A-nociceptin-$H_N$/A fusion (SEQ ID NO:39) as a template. Oligonucleotides are designed encoding the YGGFM met-enkephalin peptide (SEQ ID NO:181), ensuring standard *E. coli* codon usage is maintained and no additional restriction sites are incorporated, flanked by sequences complimentary to the linker region of the LC/A-nociceptin-$H_N$/A fusion (SEQ ID NO:39) either side on the nociceptin section. The SDM product is checked by sequencing and the final construct containing the LC-linker-met enkephalin-spacer-$H_N$ ORF (SEQ ID NO:47) for expression as a protein of the sequence illustrated in SEQ ID NO:48.

Example 24

Preparation of a LC/A-β Endorphin-$H_N$/A Fusion Protein

Following the methods used in Examples 1 and 2, the LC/A (SEQ ID NO:27) and $H_N$/A (SEQ ID NO:28) are created and inserted into the A serotype 13 endorphin linker arranged as BamHI-Sail-linker-protease site-β endorphin-NheI-spacer-SpeI-PstI-XbaI-stop codon-HindIII (SEQ ID NO:37). The final construct contains the LC-linker-β endorphin-spacer-$H_N$ ORF (SEQ ID NO:49) for expression as a protein of the sequence illustrated in SEQ ID NO:50.

Example 25

Preparation of a LC/A-Nociceptin Variant-$H_N$/A Fusion Protein

Following the methods used in Examples 1 and 2, the LC/A (SEQ ID NO:27) and $H_N$/A (SEQ ID NO:28) are created and inserted into the A serotype nociceptin variant linker arranged as BamHI-Sail-linker-protease site-nociceptin variant-NheI-spacer-SpeI-PstI-XbaI-stop codon-HindIII (SEQ ID NO:38). The final construct contains the LC-linker-nociceptin variant-spacer-$H_N$ ORF (SEQ ID NO:51) for expression as a protein of the sequence illustrated in SEQ ID NO:52.

Example 26

Purification Method for LC/A-Nociceptin-$H_N$/A Fusion Protein

Defrost falcon tube containing 25 ml 50 mM HEPES pH 7.2, 200 mM NaCl and approximately 10 g of *E. coli* BL21 cell paste. Make the thawed cell paste up to 80 ml with 50 mM HEPES pH 7.2, 200 mM NaCl and sonicate on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 1 unit of factor Xa per 100 μg fusion protein and Incubate at 25° C. static overnight. Load onto a 0.1 M $NiSO_4$ charged Chelating column (20-30 ml column is sufficient) equilibrated with 50 mM HEPES pH 7.2, 200 mM NaCl. Wash column to baseline with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Example 27

Preparation of a LC/A-Nociceptin-$H_N$/A Fusion Protein (Nociceptin is N-Terminal of the $H_N$-Chain)

The linker-nociceptin-spacer insert is prepared as described in Example 19.

Preparation of the LC/A-Nociceptin-$H_N$/A fusion

In order to create the LC-linker-nociceptin-spacer-$H_N$ construct (SEQ ID NO:39), the pCR 4 vector encoding the linker (SEQ ID NO:33) is cleaved with BamHI+SalI restriction enzymes. This cleaved vector then serves as the recipient for insertion and ligation of the LC/A DNA (SEQ ID NO:27) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:28) is then cleaved with PstI+HindIII restriction enzymes and inserted into the similarly cleaved pMAL-LC/A-linker construct. The final construct contains the LC-linker-nociceptin-spacer-$H_N$ ORF (SEQ ID NO:39) for expression as a protein of the sequence illustrated in SEQ ID NO:40.

Example 28

Preparation of a Nociceptin-LC/A-$H_N$/A Fusion Protein (Nociceptin is N-Terminal of the LC-Chain)

In order to create the nociceptin-spacer-LC/A-$H_N$/A construct, an A serotype linker with the addition of a Factor Xa site for activation, arranged as BamHI-Sail-linker-protease site-linker-PstI-XbaI-stop codon-HindIII (SEQ ID NO:34) is synthesised as described in Example 27. The pCR 4 vector encoding the linker is cleaved with BamHI+SalI restriction enzymes. This cleaved vector then serves as the recipient for insertion and ligation of the LC/A DNA (SEQ ID NO:27) also cleaved with BamHI+SalI. The resulting plasmid DNA is then cleaved with BamHI+HindIII restriction enzymes and the LC/A-linker fragment inserted into a similarly cleaved vector containing the synthesised N-terminal presentation nociceptin insert (SEQ ID NO:35). This construct is then cleaved with AvaI+HindIII and inserted into an expression vector such as the pMAL plasmid (NEB). The $H_N$/A DNA (SEQ ID NO:28) is then cleaved with PstI+HindIII restriction enzymes and inserted into the similarly cleaved pMAL-nociceptin-LC/A-linker construct. The final construct contains the nociceptin-spacer-LC/A-$H_N$/A ORF (SEQ ID NO:63) for expression as a protein of the sequence illustrated in SEQ ID NO:64.

Example 29

Preparation and Purification of an LC/A-Nociceptin-$H_N$/A Fusion Protein Family with Variable Spacer Length Using the same strategy as employed in Example 19, a range of DNA linkers were prepared that encoded nociceptin and variable spacer content. Using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-nociceptin-NheI-spacer-SpeI-PstI-XbaI-stop codon-HindIII (SEQ ID NO:65 to SEQ ID NO:69). It is important to ensure the correct reading frame is maintained for the spacer, nociceptin and restriction sequences and that the XbaI sequence is not preceded by the bases, TC which would result on DAM methylation. The DNA sequence is screened for restriction sequence incorporation and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The spacers that were created included:

TABLE 2

| Code | Protein sequence of the linker | SEQ ID NO: of the linker DNA |
|---|---|---|
| GS10 | ALAGGGGSALVLQ | 182 |
| GS15 | ALAGGGGSGGGGSALVLQ | 183 |
| GS25 | ALAGGGGSGGGGSGGGGSGGGGSALVLQ | 184 |
| GS30 | ALAGGGGSGGGGSGGGGSGGGGSGGGGSALVLQ | 185 |
| HX27 | ALAAEAAAKEAAAKEAAAKAGGGGSALVLQ | 186 |

By way of example, in order to create the LC/A-CPN (GS15)-$H_N$/A fusion construct (SEQ ID NO:70), the pCR 4 vector encoding the linker (SEQ ID NO:66) is cleaved with BamHI+SalI restriction enzymes. This cleaved vector then serves as the recipient vector for insertion and ligation of the LC/A DNA (SEQ ID NO:27) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:28) is then cleaved with PstI+HindIII restriction enzymes and inserted into the similarly cleaved pMAL-LC/A-linker construct. The final construct contains the LC/A-CPN(GS15)-$H_N$/A ORF (SEQ ID NO:70) for expression as a protein of the sequence illustrated in SEQ ID NO:71.

As a further example, to create the LC/A-CPN(GS25)-$H_N$/A fusion construct (SEQ ID NO:72), the pCR 4 vector encoding the linker (SEQ ID NO:67) is cleaved with BamHI+SalI restriction enzymes. This cleaved vector then serves as the recipient vector for insertion and ligation of the LC/A DNA (SEQ ID NO:27) cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:28) is then cleaved with PstI+HindIII restriction enzymes and inserted into the similarly cleaved pMAL-LC/A-linker construct. The final construct contains the LC/A-CPN(GS25)-$H_N$/A ORF (SEQ ID NO:72) for expression as a protein of the sequence illustrated in SEQ ID NO:73.

Variants of the LC/A-CPN-$H_N$/A fusion consisting of GS10, GS30 and HX27 are similarly created. Using the purification methodology described in Example 26, fusion protein is purified from *E. coli* cell paste. FIG. 12 illustrates the purified product obtained in the case of LC/A-CPN(GS10)-$H_N$/A, LC/A-CPN(GS15)-$H_N$/A, LC/A-CPN(GS25)-$H_N$/A, LC/A-CPN(GS30)-$H_N$/A and LC/A-CPN(HX27)-$H_N$/A.

Example 30

Assessment of In Vitro Efficacy of an LC/A-Nociceptin-$H_N$/A Fusion

Fusion protein prepared according to Examples 2 and 9 was assessed in the eDRG neuronal cell model.

Assays for the inhibition of substance P release and cleavage of SNAP-25 have been previously reported (Duggan et al., 2002, *J. Biol. Chem.,* 277, 34846-34852). Briefly, dorsal root ganglia neurons are harvested from 15-day-old fetal Sprague-Dawley rats and dissociated cells plated onto 24-well plates coated with Matrigel at a density of $1\times10^6$ cells/well. One day post-plating the cells are treated with 10 μM cytosine β-D-arabinofuranoside for 48 h. Cells are maintained in Dulbecco's minimal essential medium supplemented with 5% heat-inactivated fetal bovine serum, 5 mM L-glutamine, 0.6% D-glucose, 2% B27 supplement, and 100 ng/ml 2.5S mouse nerve growth factor. Cultures are maintained for 2 weeks at 37° C. in 95% air/5% $CO_2$ before addition of test materials.

Release of substance P from eDRG is assessed by enzyme-linked immunosorbent assay. Briefly, eDRG cells are washed twice with low potassium-balanced salt solution (BSS: 5 mM KCl, 137 mM NaCl, 1.2 mM $MgCl_2$, 5 mM glucose, 0.44 mM $KH_2PO_4$, 20 mM HEPES, pH 7.4, 2 mM $CaCl_2$). Basal samples are obtained by incubating each well for 5 min. with 1 ml of low potassium BSS. After removal of this buffer, the cells are stimulated to release by incubation with 1 ml of high potassium buffer (BSS as above with modification to include 100 mM KCl isotonically balanced with NaCl) for 5 min. All samples are removed to tubes on ice prior to assay of substance P. Total cell lysates are prepared by addition of 250 μl of 2 M acetic acid/0.1% trifluoroacetic acid to lyse the cells, centrifugal evaporation, and resuspension in 500 μl of assay buffer. Diluted samples are assessed for substance P content. Substance P immunoreactivity is measured using Substance P Enzyme Immunoassay Kits (Cayman Chemical Company or R&D Systems) according to manufacturers' instructions. Substance P is expressed in pg/ml relative to a standard substance P curve run in parallel.

SDS-PAGE and Western blot analysis were performed using standard protocols (Novex). SNAP-25 proteins were resolved on a 12% Tris/glycine polyacrylamide gel (Novex) and subsequently transferred to nitrocellulose membrane. The membranes were probed with a monoclonal antibody (SMI-81) that recognises cleaved and intact SNAP-25. Specific binding was visualised using peroxidase-conjugated secondary antibodies and a chemiluminescent detection system. Cleavage of SNAP-25 was quantified by scanning densitometry (Molecular Dynamics Personal SI, ImageQuant data analysis software). Percent SNAP-25 cleavage was calculated according to the formula: (Cleaved SNAP-25/(Cleaved+Intact SNAP-25))×100.

Following exposure of eDRG neurons to an LC/A-nociceptin-$H_N$/A fusion (termed CPN-A), both inhibition of substance P release and cleavage of SNAP-25 are observed (FIG. 13). After 24 h exposure to the fusion, 50% of maximal SNAP-25 cleavage is achieved by a fusion concentration of 6.3±2.5 nM.

The effect of the fusion is also assessed at defined time points following a 16 h exposure of eDRG to CPN-A. FIG. 14 illustrates the prolonged duration of action of the CPN-A fusion protein, with measurable activity still being observed at 28 days post exposure.

Example 31

Assessment of In Vitro Efficacy of an LC/A-Nociceptin Variant-$H_N$/A Fusion Fusion protein prepared according to Examples 8 and 9 was assessed in the eDRG neuronal cell mode using the method described in Example 30.

Following exposure of eDRG neurons to an LC/A-nociceptin variant-$H_N$/A fusion (termed CPNv-A), both inhibition of substance P release and cleavage of SNAP-25 are observed. After 24 h exposure to the fusion, 50% of maximal SNAP-25 cleavage is achieved by a fusion concentration of 1.4±0.4 nM (FIG. 15).

The effect of the fusion is also assessed at defined time points following a 16 h exposure of eDRG to CPN-A. FIG. 16 illustrates the prolonged duration of action of the CPN-A fusion protein, with measurable activity still being observed at 24 days post exposure.

The binding capability of the CPNv-A fusion protein is also assessed in comparison to the CPN-A fusion. FIG. 17 illustrates the results of a competition experiment to determine binding efficacy at the ORL-1 receptor. CPNv-A is demonstrated to displace [3H]-nociceptin, thereby confirming that access to the receptor is possible with the ligand in the central presentation format.

Example 32

Preparation of an LC/A-nociceptin Variant-$H_N$/A Fusion Protein that is Activated by Treatment with Enterokinase Following the methods used in Examples 1 and 2, the LC/A (SEQ ID NO:27) and $H_N$/A (SEQ ID NO:28) are created and inserted into the A serotype nociceptin variant linker arranged as BamHI-Sail-linker-enterokinase protease site-nociceptin variant-NheI-spacer-SpeI-PstI-XbaI-stop codon-HindIII (SEQ ID NO:74). The final construct contains the LC-linker-nociceptin variant-spacer-$H_N$ ORF sequences (SEQ ID NO:75) for expression as a protein of the sequence illustrated in SEQ ID NO:76. The fusion protein is termed CPNv(Ek)-A. FIG. 18 illustrates the purification of CPNv(Ek)-A from *E. coli* following the methods used in Example 26 but using Enterokinase for activation at 0.00064 μg per 100 μg of fusion protein.

Example 33

Assessment of In Vitro Efficacy of an LC/A-Nociceptin Variant-$H_N$/A Fusion that has been Activated by Treatment with Enterokinase The CPNv(Ek)-A prepared in Example 32 is obtained in a purified form and applied to the eDRG cell model to assess cleavage of SNAP-25 (using methodology from Example 30). FIG. 19 illustrates the cleavage of SNAP-25 following 24 h exposure of eDRG to CPNv(Ek)-A. The efficiency of cleavage is observed to be similar to that achieved with the Factor Xa-cleaved material, as recorded in Example 31.

Example 34

Preparation of an LC/C-nociceptin Variant-$H_N$/C Fusion Protein with a Factor Xa Activation Linker Derived from Serotype A Following the methods used in Example 21, the LC/C (SEQ ID NO:31) and $H_N$/C (SEQ ID NO:32) are created and inserted into the A serotype nociceptin variant linker arranged as BamHI-Sail-linker-nociceptin variant-NheI-spacer-SpeI-PstI-XbaI-stop codon-HindIII II (SEQ ID NO:77). The final construct contains the LC-linker-nociceptin variant-spacer-$H_N$ ORF sequences (SEQ ID NO:78) for expression as a protein of the sequence illustrated in SEQ ID NO:79. The fusion protein is termed CPNv-C (act. A). FIG. 20 illustrates the purification of CPNv-C (act. A) from *E. coli* following the methods used in Example 26.

Example 35

Assessment of In Vitro Efficacy of an LC/C-nociceptin Variant-$H_N$/C Fusion Protein Following the methods used in Example 26, the CPNv-C (act. A) prepared in Example 34 is obtained in a purified form and applied to the eDRG cell model to assess cleavage of SNAP-25 (using methodology from Example 30). After 24 h exposure to the fusion, 50% of maximal syntaxin cleavage is achieved by a fusion concentration of 3.1±2.0 nM. FIG. 21 illustrates the cleavage of syntaxin following 24 h exposure of eDRG to CPNv-C (act. A).

Example 36

Assessment of In Vivo Efficacy of an LC/A-nociceptin-HN/A Fusion

The ability of an LC/A-nociceptin-$H_N$/A fusion (CPN/A) to inhibit acute capsaicin-induced mechanical allodynia is evaluated following subcutaneous intraplantar injection in the rat hind paw. Test animals are evaluated for paw withdrawal frequency (PWF %) in response to a 10 g Von Frey filament stimulus series (10 stimuli x 3 trials) prior to recruitment into the study, after subcutaneous treatment with CPN/A but before capsaicin, and following capsaicin challenge post-injection of CPN/A (average of responses at 15' and 30'). Capsaicin challenge is achieved by injection of 10 μL of a 0.3% solution. Sample dilutions are prepared in 0.5% BSA/saline. FIG. 22 illustrates the reversal of mechanical allodynia that is achieved by pre-treatment of the animals with a range of concentrations of LC/A-nociceptin-HN/A fusion.

The ability of an LC/A-nociceptin-HN/A fusion (CPN/A) to inhibit streptozotocin (STZ)-induced mechanical (tactile) allodynia in rats is evaluated. STZ-induced mechanical allodynia in rats is achieved by injection of streptozotocin (i.p. or i.v.) which yields destruction of pancreatic β-cells leading to loss of insulin production, with concomitant metabolic stress (hyperglycemia and hyperlipidemia). As such, STZ induces Type I diabetes. In addition, STZ treatment leads to progressive development of neuropathy, which serves as a model of chronic pain with hyperalgesia and allodynia that may reflect signs observed in diabetic humans (peripheral diabetic neuropathy).

Male Sprague-Dawley rats (250-300 g) are treated with 65 mg/kg STZ in citrate buffer (I.V.) and blood glucose and lipid are measured weekly to define the readiness of the model. Paw Withdrawal Threshold (PWT) is measured in response to a Von Frey filament stimulus series over a period of time. Allodynia is said to be established when the PWT on two consecutive test dates (separated by 1 week) measures below 6 g on the scale. At this point, rats are randomized to either a saline group (negative efficacy control), gabapentin group (positive efficacy control) or a test group (CPN/A). Test materials (20-25 μl) are injected subcutaneously as a single injection (except gabapentin) and the PWT is measured at 1 day post-treatment and periodically thereafter over a 2-week period. Gabapentin (30 mg/kg i.p.@3 ml/kg injection volume) is injected daily, 2 hours prior to the start of PWT testing. FIG. 23 illustrates the reversal of allodynia achieved by pre-treatment of the animals with 750 ng of CPN/A. Data were obtained over a 2-week period after a single injection of CPN/A

Example 37

Assessment of In Vivo Efficacy of an LC/A-nociceptin Variant-$H_N$/A Fusion

The ability of an LC/A-nociceptin variant-$H_N$/A fusion (CPNv/A) to inhibit capsaicin-induced mechanical allodynia is evaluated following subcutaneous intraplantar injection in the rat hind paw. Test animals are evaluated for paw withdrawal frequency (PWF %) in response to a 10 g Von Frey filament stimulus series (10 stimuli×3 trials) prior to recruitment into the study (Pre-Treat); after subcutaneous intraplantar treatment with CPNv/A but before capsaicin (Pre-CAP); and following capsaicin challenge post-injection of CPNv/A (average of responses at 15' and 30'; CAP). Capsaicin challenge is achieved by injection of 10 μL of a 0.3% solution. Sample dilutions are prepared in 0.5% BSA/saline.

FIG. 24 illustrates the reversal of allodynia that is achieved by pre-treatment of the animals with a range of concentrations of LC/A-nociceptin variant-$H_N$/A fusion in comparison to the reversal achieved with the addition of LC/A-nociceptin-$H_N$/A fusion. These data are expressed as a normalized paw withdrawal frequency differential, in which the difference between the peak response (post-capsaicin) and the baseline response (pre-capsaicin) is expressed as a percentage. With this analysis, it can be seen that CPNv/A is more potent than CPN/A since a lower dose of CPNv/A is required to achieve similar analgesic effect to that seen with CPN/A.

Example 38

Preparation of an LC/A-Leu Enkephalin-$H_N$/A Fusion Protein

Due to the small, five-amino acid, size of the leu-enkephalin ligand the LC/A-leu enkephalin-$H_N$/A fusion is created by site directed mutagenesis [for example using Quickchange (Stratagene Inc.)] using the LC/A-nociceptin-$H_N$/A fusion (SEQ ID NO:39) as a template. Oligonucleotides are designed encoding the YGGFL leu-enkephalin peptide, ensuring standard *E. coli* codon usage is maintained and no additional restriction sites are incorporated, flanked by sequences complimentary to the linker region of the LC/A-nociceptin-$H_N$/A fusion (SEQ ID NO:39) either side on the nociceptin section. The SDM product is checked by sequencing and the final construct containing the LC-linker-leu enkephalin-spacer-$H_N$ ORF (SEQ ID NO:80) for expression as a protein of the sequence illustrated in SEQ ID NO:81. The fusion protein is termed CPLE-A. FIG. 25 illustrates the purification of CPLE-A from *E. coli* following the methods used in Example 26.

Example 39

Expression and Purification of an LC/A-beta-endorphin-$H_N$/A Fusion Protein Following the methods used in Example 26, and with the LC/A-beta-endorphin-$H_N$/A fusion protein (termed CPBE-A) created in Example 24, the CPBE-A is purified from *E. coli*. FIG. 26 illustrates the purified protein as analysed by SDS-PAGE.

Example 40

Preparation of an LC/A-nociceptin Mutant-$H_N$/A Fusion Protein

Due to the single amino acid modification necessary to mutate the nociceptin sequence at position 1 from a Phe to a Tyr, the LC/A-nociceptin mutant-$H_N$/A fusion is created by site directed mutagenesis [for example using Quickchange (Stratagene Inc.)] using the LC/A-nociceptin-$H_N$/A fusion (SEQ ID NO:39) as a template. Oligonucleotides are designed encoding tyrosine at position 1 of the nociceptin sequence, ensuring standard *E. coli* codon usage is maintained and no additional restriction sites are incorporated, flanked by sequences complimentary to the linker region of the LC/A-nociceptin-$H_N$/A fusion (SEQ ID NO:39) either side on the nociceptin section. The SDM product is checked by sequencing and the final construct containing the LC/A-nociceptin mutant-spacer-$H_N$/A fusion ORF (SEQ ID NO:82) for expression as a protein of the sequence illustrated in SEQ ID NO:83. The fusion protein is termed CPOP-A. FIG. 27 illustrates the purification of CPOP-A from *E. coli* following the methods used in Example 26.

Example 41

Preparation and Assessment of an LC/A-nociceptin Variant Mutant-$H_N$/A Fusion Protein Due to the single amino acid modification necessary to mutate the nociceptin sequence at position 1 from a Phe to a Tyr, the LC/A-nociceptin variant mutant-$H_N$/A fusion is created by site directed mutagenesis [for example using Quickchange (Stratagene Inc.)] using the LC/A-nociceptin variant-$H_N$/A fusion (SEQ ID NO:51) as a template. Oligonucleotides are designed encoding tyrosine at position 1 of the nociceptin sequence, ensuring standard *E. coli* codon usage is maintained and no additional restriction sites are incorporated, flanked by sequences complimentary to the linker region of the LC/A-nociceptin variant-$H_N$/A fusion (SEQ ID NO:51) either side on the nociceptin section. The SDM product is checked by sequencing and the final construct containing the LC/A-nociceptin mutant-spacer-$H_N$/A fusion ORF (SEQ ID NO:84) for expression as a protein of the sequence illustrated in SEQ ID NO:85. The fusion protein is termed CPOPv-A. FIG. 28 illustrates the purification of CPOPv-A from *E. coli* following the methods used in Example 26.

Using methodology described in Example 30, CPOPv-A is assessed for its ability to cleave SNAP-25 in the eDRG cell model. FIG. 29 illustrates that CPOPv-A is able to cleave SNAP-25 in the eDRG model, achieving cleavage of 50% of the maximal SNAP-25 after exposure of the cells to approximately 5.9 nM fusion for 24 h.

Example 42

Preparation of an IgA Protease-nociceptin Variant-$H_N$/A Fusion Protein

The IgA protease amino acid sequence was obtained from freely available database sources such as GenBank (accession number P09790). Information regarding the structure of the *N. Gonorrhoeae* IgA protease gene is available in the literature (Pohlner et al., Gene structure and extracellular secretion of *Neisseria gonorrhoeae* IgA protease, *Nature,* 1987, 325 (6103), 458-62). Using Backtranslation tool v2.0 (Entelechon), the DNA sequence encoding the IgA protease modified for *E. coli* expression was determined. A BamHI recognition sequence was incorporated at the 5' end and a codon encoding a cysteine amino acid and SalI recognition sequence were incorporated at the 3' end of the IgA DNA. The DNA sequence was screened using MapDraw, (DNASTAR Inc.) for restriction enzyme cleavage sequences incorporated during the back translation. Any cleavage sequences that are found to be common to those required for cloning were removed manually from the proposed coding sequence is ensuring common *E. coli* codon usage is maintained. *E. coli* codon usage was assessed Graphical Codon Usage Analyser (Geneart), and the % GC content and codon usage ratio assessed by reference to published codon usage tables. This optimised DNA sequence (SEQ ID NO:86) containing the IgA open reading frame (ORF) is then commercially synthesized.

The IgA (SEQ ID NO:86) is inserted into the LC-linker-nociceptin variant-spacer-$H_N$ ORF (SEQ ID NO:51) using BamHI and SalI restriction enzymes to replace the LC with the IgA protease DNA. The final construct contains the IgA-linker-nociceptin variant-spacer-$H_N$ ORF (SEQ ID NO:87) for expression as a protein of the sequence illustrated in SEQ ID NO:88.

Example 43

Preparation and Assessment of a Nociceptin Targeted Endopeptidase Fusion Protein with a Removable Histidine Purification Tag DNA was prepared that encoded a Factor Xa removable his-tag (his6), although it is clear that alternative proteases site such as Enterokinase and alternative purification tags such as longer histidine tags are also possible. Using one of a variety of reverse translation software tools [for example EditSeq best *E. coli* reverse translation (DNASTAR Inc.), or Backtranslation tool v2.0 (Entelechon)], the DNA sequence encoding the Factor Xa removable his-tag region is determined. Restriction sites are then incorporated into the DNA sequence and can be arranged as NheI-linker-SpeI-PstI-$H_N$/A-XbaI-LEIEGRSGHHHHHHStop codon-HindIII (SEQ ID NO:89). The DNA sequence is screened for restriction sequence incorporated and any additional sequences are removed manually from the remaining sequence ensuring common E.

coli codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector. In order to create CPNv-A-FXa-HT (SEQ ID NO:90, removable his-tag construct) the pCR 4 vector encoding the removable his-tag is cleaved with NheI and HindIII. The NheI-HindIII fragment is then inserted into the LC/A-CPNv-$H_N$/A vector (SEQ ID NO:51) that has also been cleaved by NheI and HindIII. The final construct contains the LC/A-linker-nociceptin variant-spacer-$H_N$-FXa-Histag-HindIII ORF sequences (SEQ ID NO:90) for expression as a protein of the sequence illustrated in SEQ ID NO:91. FIG. 30 illustrates the purification of CPNv-A-FXa-HT from *E. coli* following the methods used in Example 26.

Example 44

Preparation of a Leu-enkephalin Targeted Endopeptidase Fusion Protein Containing a Translocation Domain Derived from Diphtheria Toxin The DNA sequence is designed by back translation of the amino acid sequence of the translocation domain of the diphtheria toxin (obtained from freely available database sources such as GenBank (accession number 1×DTT) using one of a variety of reverse translation software tools [for example EditSeq best *E. coli* reverse translation (DNASTAR Inc.), or Backtranslation tool v2.0 (Entelechon)]. Restriction sites are then incorporated into the DNA sequence and can be arranged as NheI-Linker-SpeI-PstI-diphtheria translocation domain-XbaI-stop codon-HindIII (SEQ ID NO:92). PstI/XbaI recognition sequences are incorporated at the 5' and 3' ends of the translocation domain respectively of the sequence maintaining the correct reading frame. The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the diphtheria translocation domain is then commercially synthesized as NheI-Linker-SpeI-PstI-diphtheria translocation domain-XbaI-stop codon-HindIII (for example by Entelechon, Geneart or Sigma-Genosys) and is provided in the pCR 4 vector (Invitrogen). The pCR 4 vector encoding the diphtheria translocation domain is cleaved with NheI and XbaI. The NheI-XbaI fragment is then inserted into the LC/A-CPLE-$H_N$/A vector (SEQ ID NO:80) that has also been cleaved by NheI and XbaI. The final construct contains the LC/A-leu-enkephalin-spacer-diphtheria translocation domain ORF sequences (SEQ ID NO:93) for expression as a protein of the sequence illustrated in SEQ ID NO:94.

Example 45

Preparation of a Nociceptin Variant Targeted Endopeptidase Fusion Protein Containing a LC Domain Derived from Tetanus Toxin The DNA sequence is designed by back translation of the tetanus toxin LC amino acid sequence (obtained from freely available database sources such as GenBank (accession number X04436) using one of a variety of reverse translation software tools [for example EditSeq best *E. coli* reverse translation (DNASTAR Inc.), or Backtranslation tool v2.0 (Entelechon)]. BamHI/SalI recognition sequences are incorporated at the 5' and 3' ends respectively of the sequence maintaining the correct reading frame (SEQ ID NO:95). The DNA sequence is screened (using software such as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the tetanus toxin LC open reading frame (ORF) is then commercially synthesized (for example by Entelechon, Geneart or Sigma-Genosys) and is provided in the pCR 4 vector (invitrogen). The pCR 4 vector encoding the TeNT LC is cleaved with BamHI and SalI. The BamHI-SalI fragment is then inserted into the LC/A-CPNv-$H_N$/A vector (SEQ ID NO:51) that has also been cleaved by BamHI and SalI. The final construct contains the TeNT LC-linker-nociceptin variant-spacer-$H_N$ ORF sequences (SEQ ID NO:96) for expression as a protein of the sequence illustrated in SEQ ID NO:97.

Example 46

Preparation of an LC/C-nociceptin Variant-$H_N$/C Fusion Protein with a Native Serotype C Linker that is Susceptible to Factor Xa Cleavage Following the methods used in Example 21, the LC/C (SEQ ID NO:31) and $H_N$/C (SEQ ID NO:32) are created and inserted into the C serotype nociceptin variant linker arranged as BamHI-SaiI-linker-nociceptin variant-NheI-spacer-SpeI-PstI-XbaI-stop codon-HindIII II (SEQ ID NO:98). The final construct contains the LC-linker-nociceptin variant-spacer-$H_N$ ORF sequences (SEQ ID NO:99) for expression as a protein of the sequence illustrated in SEQ ID NO:100. The fusion protein is termed CPNv-C (act. C).

Example 47

Construction of CHO-K1 OP2 Receptor Activation Assay and SNAP-25 Cleavage Assay Cell-Line Creation CHO OP2 cell line was purchased from Perkin Elmer (ES-541-C, lot 451-719-A). Cells were transfected with SNAP-25 DNA using Lipofectamine™ 2000 and incubated for 4 hours before media replacement. After 24 hours, cells were transferred to a T175 flask. 100 ug/ml Zeocin was added after a further 24 hours to begin selection of SNAP-25 expressing cells, and 5 ug/ml Blasticidin added to maintain selective pressure for the receptor. Cells were maintained in media containing selection agents for two weeks, passaging cells every two to three days to maintain 30-70% confluence. Cells were then diluted in selective media to achieve 0.5 cell per well in a 96 well microplate. After a few days, the plates were examined under a microscope, and those containing single colonies were marked. Media in these wells was changed weekly. As cells became confluent in the wells, they were transferred to T25 flasks. When they had expanded sufficiently each clone was seeded to 24 wells of a 96 well plate, plus a frozen stock vial created. LC/A-CPDY-$H_N$A fusion and LC/A-$H_N$A were applied to the cells for 24 hours, and then western blots performed to detect SNAP-25 cleavage. Clones from which SNAP-25 bands were strong and cleavage levels were high with fusion were maintained for further investigation. Full dose curves were run on these, and the clone (D30) with the highest differential between LC/A-CPDY-$H_N$A fusion and LC/A-$H_N$A cleavage levels was selected.

OP2 Receptor Activation Assay

The OP2 receptor activation measures the potency and intrinsic efficacy of ligands at OP2 receptor in transfected CHO-K1 cells by quantifying the reduction of forskolin-stimulated intracellular cAMP using a FRET-based cAMP (Perkin Elmer LANCE cAMP kit). After stimulation, a fluorescently labelled cAMP tracer (Europium-streptavadin/biotin-cAMP) and fluorescently (Alexa) labelled anti-cAMP antibody are added to the cells in a lysis buffer. cAMP from the cells competes with the cAMP tracer for antibody binding sites. When read, a light pulse at 320 nm excites the fluorescent portion (Europium) of the cAMP tracer. The energy emitted from the europium is is transferred to the Alexa fluor-labelled antibodies bound to the tracer, generating a TR-FRET signal at 665 nm (Time-resolved fluorescence resonance energy transfer is based on the proximity of the donor label, europium, and the acceptor label, Alexa fluor, which have been brought together by a specific binding reaction). Residual energy from the europium produces light at 615 nm. In agonist treated cells there will be less cAMP to compete with the tracer so a dose dependant increase in signal at 665 nm will be observed compared with samples treated with forskolin alone. The signal at 665 nm signal is converted to cAMP concentration by interpolation to a cAMP standard curve which is included in each experiment.

Culture of Cells for Receptor Activation Assay:

Cells were seeded and cultured in T175 flasks containing Ham F12 with Glutamax, 10% Foetal bovine serum, 5 μml-1 Blasticidin and 100 μml-1 Zeocin. The flasks were incubated at 37° C. in a humidified environment containing 5% $CO_2$ until 60-80% confluent. On the day of harvest the media was removed and the cells washed twice with 25 ml PBS. The cells were removed from the flask by addition of 10 ml of Tryple Express, and incubation at 37° C. for 10 min followed by gentle tapping of the flask. The dislodged cells were transferred to a 50 ml centrifuge tube and the flask washed twice with 10 ml media which was added to the cell suspension. The tube was centrifuged at 1300×g for 3 min and the supernatant removed. Cells were gently re-suspended in 10 ml media (if freezing cells) or assay buffer (if using 'fresh' cells in assay), and a sample was removed for counting using a nucleocounter (ChemoMetec). Cells for use 'fresh' in an assay were diluted further in assay buffer to the appropriate concentration. Cells harvested for freezing were re-centrifuged (1300×g; 3 min), the supernatant removed and cells re-suspended in Synth-a-freeze at 4° C. to $3\times10^6$ cells/ml. Cryovials containing 1 ml suspension each were placed in a chilled Nalgene Mr Frosty freezing container (−1° C./minute cooling rate), and left overnight in a −80° C. freezer. The following day vials were transferred to the vapour phase of a liquid nitrogen storage tank.

Dilution of Test Materials and Cell Assay

Using Gilson pipettes and Sigmacoted or lo-bind tips, test materials and standards were diluted to the appropriate concentrations in the wells of the first two columns of an eppendorf 500 μl deep-well lo-bind plate, in assay buffer containing 10 μM forskolin. The is chosen concentrations in columns one and two were half a log unit apart. From these, serial 1:10 dilutions were made across the plate (using an electronic eight channel pipette with sigmacote or lo-bind tips) until eleven concentrations at half log intervals had been created. In the twelfth column, assay buffer only was added as a 'basal'. Using a 12 channel digital pipette, 10 μl of sample from the lo-bind plate was transferred to the optiplate 96 well microplate.

To wells containing the standard curve, 10 ul of assay buffer was added using a multichannel digital pipette. To wells containing the test materials, 10 ul of cells in assay buffer at the appropriate concentration were added. Plates were sealed and incubated for 120 min at room temperature, for the first hour on an IKA MTS 2/4 orbital shaker set to maximum speed.

Detection

LANCE Eu-W8044 labelled streptavidin (Eu-SA) and Biotin-cAMP (b-cAMP) were diluted in cAMP Detection Buffer (both from Perkin Elmer LANCE cAMP kit) to create sub-stocks, at dilution ratios of 1:17 and 1:5, respectively. The final detection mix was prepared by diluting from the two sub stocks into detection buffer at a ratio of 1:125. The mixture was incubated for 15-30 min at room temperature before addition of 1:200 Alexa Fluor® 647-anti cAMP Antibody (Alexa-Fluor Ab). After briefly vortex mixing, 20 μl was immediately added to each well using a digital multichannel pipette. Microplate sealers were applied and plates incubated for 24 h at room temperature (for the first hour on an IKA MTS 2/4 orbital shaker set to maximum speed). Plate sealers were removed prior to reading on the Envision.

FIGS. 36 and 37 show that dynorphin conjugates with LC/A-$H_N$/A, LC/B-$H_N$/B, LC/C—$H_N$/C and LC/D-$H_N$/D backbones active the OP2 receptor.

CHO-K1 OP2 SNAP-25 Cleavage Assay

Cultures of cells were exposed to varying concentrations of fusion protein for 24 hours. Cellular proteins were separated by SDS-PAGE and western blotted with anti-SNAP-25 antibody to facilitate assessment of SNAP-25 cleavage. SNAP-25 cleavage calculated by densitometric analysis (Syngene).

Plating Cells

Prepare cells at 2×10e5 cells/ml and seed 125 μl per well of 96 well plate. Use the following media: 500 ml Gibco Ham F12 with Glutamax (product code 31765068), 50 ml FBS, 5 ug/ml Blasticidin (250 μl aliquot from box in freezer, G13) (Calbiochem #203351, 10 ml at 10 mg/ml), 100 ug/ml Zeocin (500 μl from box in freezer, G35). (Invitrogen from Fisher, 1 g in 8×1.25 ml tubes at 100 mg/ml product code VXR25001). Allow cells to grow for 24 hrs (37° C., 5% $CO_2$, humidified atmosphere).

Cell Treatment

Prepare dilutions of test protein for a dose range of each test proteins (make up double (2×) the desired final concentrations because 125 μl will be applied directly onto 125 μl of media already in each well). Filter sterilize CHO KOR D30 feeding medium (20 ml syringe, 0.2 μm syringe filter) to make the dilutions. Add the filtered medium into 5 labelled bijoux's (7 ml tubes), 0.9 ml each using a Gilson pipette or multi-stepper. Dilute the stock test protein to 2000 nM (working stock solution 1) and 600 nM (working stock solution 2). Using a Gilson pipette prepare 10-fold serial dilutions of each working stock, by adding 100 μl to the next concentration in the series. Pipette up and down to mix thoroughly. Repeat to obtain 4 serial dilutions for solution 1, and 3 serial dilutions for solution 2. A 0 nM control (filtered feeding medium only) should also be prepared as a negative control for each plate. Repeat the above for each test protein. In each experiment a 'standard' batch of material must be included as control/reference material, this is unliganded LC/A-$H_N$/A.

Apply Diluted Sample to CHO KOR D30 Plates

Apply 125 μl of test sample (double concentration) per well. Each test sample should be applied to triplicate wells and each dose range should include a 0 nM control. Incubate for 24 hrs (37° C., 5% $CO_2$, humidified atmosphere).

Cell Lysis

Prepare fresh lysis buffer (20 mls per plate) with 25% (4×) NuPAGE LDS sample buffer, 65% $dH_2O$ and 10% 1 M DTT. Remove medium from the CHO KOR D30 plate by inverting over a waste receptacle. Drain the remaining media from each well using a fine-tipped pipette. Lyse the cells by adding 125 μl of lysis buffer per well using a multi-stepper pipette. After a minimum of 20 mins, remove the buffer from each well to a 1.5 ml microcentrifuge tube. Tubes must be numbered to allowing tracking of the CHO KOR treatments throughout the blotting procedure. A1-A3 down to H1-H3 numbered 1-24, A4-A6 down to H4-H6 numbered 25-48, A7-A9 down to H7-H93 numbered 49-72, A10-A12 down to H10-H12 numbered 73-96. Vortex each sample and heat at 90° C. for 5-10 mins in a prewarmed heat block. Store at −20° C. or use on the same day on an SDS gel.

Gel Electrophoresis

If the sample has been stored o/n or longer, put in a heat block prewarmed to 90° C. for 5-10 mins. Set up SDS page gels, use 1 gel per 12 samples, prepare running buffer (1×, Invitrogen NuPAGE MOPS SDS Running Buffer (20×) (NP0001))≈800 ml/gel tank. Add 500 μl of NuPAGE antioxidant to the upper buffer chamber. Load 15 ul samples onto gel lanes from left to right as and load 2.5 ul of Invitrogen Magic Marker XP and 5 ul Invitrogen See Blue Plus 2 pre-stained standard and 15 ul of non-treated control. It is important to maximize the resolution of separation during SDS_PAGE. This can be achieved by running 12% bis-tris gels at 200 V for 1 hour and 25 minutes (until the pink (17 kDa) marker reaches the bottom of the tank).

Western Blotting

Complete a Semi-dry transfer: using an Invitrogen iBlot (use iBlot Programme 3 for 6 minutes). Put the nitrocellulose membranes in individual small trays. Incubate the membranes with blocking buffer solution (5 g Marvel milk powder per 100 ml 0.1% PBS/Tween) at room temperature, on a rocker, for 1 hour. Apply primary antibody (Anti-SNAP-25 1:1000 dilution) and incubate the membranes with primary antibody (diluted in blocking buffer) for 1 hour on a rocker at room temperature. Wash the membranes by rinsing 3 times with PBS/Tween (0.1%). Then apply the secondary (Anti-Rabbit-HRP conjugate diluted 1:1000) and incubate the membranes with secondary antibody (diluted in blocking buffer) at room temperature, on a rocker, for 1 hour. Wash the membranes by rinsing 3 times with PBS/Tween (0.1%), leave membrane a minimum of 20 mins for the last wash. Detect the bound antibody using Syngene: Drain blots of PBS/Tween, mix WestDura reagents 1:1 and add to blots for 5 minutes. Ensure enough solution is added to the membranes to completely cover them. Place membrane in Syngene tray, set up Syngene software for 5 min expose time.

FIG. 34 clearly shows that LC/A-CPDY-$H_N$/A conjugates effectively cleave SNAP-25.

Example 48

Construction and Activation of Dynorphin Conjugates

Preparation of a LC/A and $H_N$/A Backbone Clones

The following procedure creates the LC and $H_N$ fragments for use as the component backbone for multidomain fusion expression. This example is based on preparation of a serotype A based clone (SEQ ID NO:27 and SEQ ID NO:28), though the procedures and methods are equally applicable to the other serotypes [illustrated by the sequence listing for serotype B (SEQ ID NO:29 and SEQ ID NO:30) and serotype C (SEQ ID NO:31 and SEQ ID NO:32)].

Preparation of Cloning and Expression Vectors pCR 4 (Invitrogen) is the chosen standard cloning vector, selected due to the lack of restriction sequences within the vector and adjacent sequencing primer sites for easy construct confirmation. The expression vector is based on the pMAL (NEB) expression vector, which has the desired restriction sequences within the multiple cloning site in the correct orientation for construct insertion (BamHI-SalI-PstI-HindIII). A fragment of the expression vector has been removed to create a non-mobilisable plasmid and a variety of different fusion tags have been inserted to increase purification options.

Preparation of Protease (e.g. LC/A) Insert

The LC/A (SEQ ID NO:27) is created by one of two ways:

The DNA sequence is designed by back translation of the LC/A amino acid sequence [obtained from freely available database sources such as GenBank (accession number P10845) or Swissprot (accession locus BXA1_CLOBO) using one of a variety of reverse translation software tools (for example EditSeq best *E. coli* reverse translation (DNASTAR Inc.), or Backtranslation tool v2.0 (Entelechon)]. BamHI/SalI recognition sequences are incorporated at the 5' and 3' ends respectively of the sequence, maintaining the correct reading frame. The DNA sequence is screened (using software such as MapDraw, DNASTAR Inc.) for restriction enzyme cleavage sequences incorporated during the back translation. Any cleavage sequences that are found to be is common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the LC/A open reading frame (ORF) is then commercially synthesized (for example by Entelechon, Geneart or Sigma-Genosys) and is provided in the pCR 4 vector.

The alternative method is to use PCR amplification from an existing DNA sequence with BamHI and SalI restriction enzyme sequences incorporated into the 5' and 3' PCR primers respectively. Complementary oligonucleotide primers are chemically synthesised by a supplier (for example MWG or Sigma-Genosys), so that each pair has the ability to hybridize to the opposite strands (3' ends pointing "towards" each other) flanking the stretch of *Clostridium* target DNA, one oligonucleotide for each of the two DNA strands. To generate a PCR product the pair of short oligonucleotide primers specific for the *Clostridium* DNA sequence are mixed with the *Clostridium* DNA template and other reaction components and placed in a machine (the 'PCR machine') that can change the incubation temperature of the reaction tube automatically, cycling between approximately 94° C. (for denaturation), 55° C. (for oligonucleotide annealing), and 72° C. (for synthesis). Other reagents required for amplification of a PCR product include a DNA polymerase (such as Taq or Pfu polymerase), each of the four nucleotide dNTP building blocks of DNA in equimolar amounts (50-200 μM) and a buffer appropriate for the enzyme optimised for $Mg^{2+}$ concentration (0.5-5 mM).

The amplification product is cloned into pCR 4 using either, TOPO TA cloning for Taq PCR products or Zero Blunt TOPO cloning for Pfu PCR products (both kits commercially available from Invitrogen). The resultant clone is checked by sequencing. Any additional restriction sequences which are not compatible with the cloning system are then removed using site directed mutagenesis [for example, using Quickchange (Stratagene Inc.)].

Preparation of Translocation (e.g. $H_N$) Insert

The $H_N$/A (SEQ ID NO:28) is created by one of two ways:

The DNA sequence is designed by back translation of the $H_N$/A amino acid sequence [obtained from freely available database sources such as GenBank (accession number P10845) or Swissprot (accession locus BXA1_CLOBO)] using one of a variety of reverse translation software tools [for example EditSeq best *E. coli* reverse translation (DNASTAR Inc.), or Backtranslation tool v2.0 (Entelechon)]. A PstI restriction sequence added to the N-terminus and XbaI-stop codon-HindIII to the C-terminus ensuring the correct reading frame is maintained. The DNA sequence is screened (using software such as MapDraw, DNASTAR Inc.) for restriction enzyme cleavage sequences incorporated during the back translation. Any sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The alternative method is to use PCR amplification from an existing DNA sequence with PstI and XbaI-stop codon-HindIII restriction enzyme sequences incorporated into the 5' and 3' PCR primers respectively. The PCR amplification is performed as described above. The PCR product is inserted into pCR 4 vector and checked by sequencing. Any additional restriction sequences which are not compatible with the cloning system are then removed using site directed mutagenesis [for example using Quickchange (Stratagene Inc.)].

Preparation of Linker-dynorphin-spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGIITSKTKSLDKGYNKALNDL. Within this sequence, it is understood that proteolytic is activation in nature leads to an $H_N$ domain that has an N-terminus of the sequence ALNDL. This sequence information is freely available from available database sources such as GenBank (accession number P10845) or Swissprot (accession locus BXA1_CLOBO). Into this linker an enterokinase site, dynorphin and spacer are incorporated; and using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-dynorphin-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example by Entelechon, Geneart or Sigma-Genosys) and is provided in the pCR 4 vector.

Preparation of the LC/A-Dynorphin-$H_N$/A Fusion

In order to create the LC-linker-dynorphin-spacer-$H_N$ construct (SEQ ID NO:102), the pCR 4 vector encoding the linker-dynorphin-spacer is cleaved with BamHI+SalI restriction enzymes. This cleaved vector then serves as the recipient vector for insertion and ligation of the LC/A DNA (SEQ ID NO:27) cleaved with BamHI+SalI. The resulting plasmid DNA is then cleaved with PstI+XbaI restriction enzymes and serves as the recipient vector for the insertion and ligation of the $H_N$/A DNA (SEQ ID NO:28) cleaved with PstI+XbaI. The final construct contains the LC-linker-dynorphin-spacer-$H_N$ ORF (SEQ ID NO:102) for transfer into expression vectors for expression to result in a fusion protein of the sequence illustrated in SEQ ID NO:103.

Examples 49

Preparation and Purification of an LC/A-dynorphin-$H_N$/A Fusion Protein Family with Variable Spacer Length Using the same strategy as employed in Example 48, a range of DNA linkers were prepared that encoded dynorphin and variable spacer content. Using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-Sail-linker-protease site-dynorphin-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC which would result on DAM methylation. The DNA sequence is screened for restriction sequence incorporation and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

The spacers that were created included are shown in Table 2 above (see Example 29).

By way of example, in order to create the LC/A-CPDY (GS25)-$H_N$/A fusion construct (SEQ ID NO:106), the pCR 4 vector encoding the linker is cleaved with BamHI+SalI restriction enzymes. This cleaved vector then serves as the recipient vector for insertion and ligation of the LC/A DNA (SEQ ID NO:27) also cleaved with BamHI+SalI. The resulting plasmid DNA is then cleaved with BamHI+HindIII restriction enzymes and the LC/A-linker fragment inserted into a similarly cleaved vector containing a unique multiple cloning site for BamHI, SalI, PstI, and HindIII such as the pMAL vector (NEB). The $H_N$/A DNA (SEQ ID NO:28) is then cleaved with PstI+HindIII restriction enzymes and inserted into the similarly cleaved pMAL-LC/A-linker construct. The final construct contains the LC/A-CPDY(GS25)-$H_N$/A ORF for expression as a protein of the sequence illustrated in SEQ ID NO:106.

Example 50

Purification Method for LC/A-dynorphin-$H_N$/A Fusion Protein

Defrost falcon tube containing 25 ml 50 mM HEPES pH 7.2, 200 mM NaCl and approximately 10 g of *E. coli* BL21 cell paste. Make the thawed cell paste up to 80 ml with 50 mM HEPES pH 7.2, 200 mM NaCl and sonicate on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 3.2 μl of enterokinase (2 μg/ml) per 1 mg fusion protein and Incubate at 25° C. static overnight. Load onto a 0.1 M $NiSO_4$ charged Chelating column (20-30 ml column is sufficient) equilibrated with 50 mM HEPES pH 7.2, 200 mM NaCl. Wash column to baseline with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Example 51

Preparation of a LC/C-dynorphin-$H_N$/C Fusion Protein with a Serotype A Activation Sequence Following the methods used in Examples 18 and 19, the LC/C (SEQ ID NO:31) and $H_N$/C (SEQ ID NO:32) are created and inserted into the A serotype linker arranged as BamHI-SalI-linker-protease site-dynorphin-NheI-spacer-SpeI-PstI-XbaI-stop codon-HindIII. The final construct contains the LC-linker-dynorphin-spacer-$H_N$ORF for expression as a protein of the sequence illustrated in SEQ ID NO:107.

Example 52

Preparation of an IgA Protease-dynorphin Variant-$H_N$/A Fusion Protein

The IgA protease amino acid sequence was obtained from freely available database sources such as GenBank (accession number P09790). Information regarding the structure of the *N. Gonorrhoeae* IgA protease gene is available in the literature (Pohlner et al., Gene structure and extracellular secretion of *Neisseria gonorrhoeae* IgA protease, *Nature,* 1987, 325 (6103), 458-62). Using Backtranslation tool v2.0 (Entelechon), the DNA sequence encoding the IgA protease modified for *E. coli* expression was determined. A BamHI recognition sequence was incorporated at the 5' end and a codon encoding a cysteine amino acid and SalI recognition sequence were incorporated at the 3' end of the IgA DNA. The DNA sequence was screened using MapDraw, (DNASTAR Inc.) for restriction enzyme cleavage sequences incorporated during the back translation. Any cleavage sequences that are found to be common to those required for cloning were removed manually from the proposed coding sequence ensuring common *E. coli* codon usage is maintained. *E. coli* codon usage was assessed Graphical Codon Usage Analyser (Geneart), and the % GC content and codon usage ratio assessed by reference to published codon usage tables. This optimised DNA sequence (SEQ ID NO:86) containing the IgA open reading frame (ORF) is then commercially synthesized.

The IgA (SEQ ID NO:86) is inserted into the LC-linker-dynorphin-spacer-$H_N$ ORF (SEQ ID NO:102) using BamHI and SalI restriction enzymes to replace the LC with the IgA protease DNA. The final construct contains the IgA-linker-dynorphin-spacer-$H_N$ ORF for expression as a protein of the sequence illustrated in SEQ ID NO:108.

Example 53

Preparation of a Dynorphin Targeted Endopeptidase Fusion Protein Containing a LC Domain Derived from Tetanus Toxin The DNA sequence is designed by back translation of the tetanus toxin LC amino acid sequence (obtained from freely available database sources such as GenBank (accession number X04436) using one of a variety of reverse translation software tools [for example EditSeq best *E. coli* reverse translation (DNASTAR Inc.), or Backtranslation tool v2.0 (Entelechon)]. BamHI/SalI recognition sequences are incorporated at the 5' and 3' ends respectively of the sequence maintaining the correct reading frame (SEQ ID NO:95). The DNA sequence is screened (using software such is as MapDraw, DNASTAR Inc.) for restriction enzyme cleavage sequences incorporated during the back translation. Any cleavage sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence containing the tetanus toxin LC open reading frame (ORF) is then commercially synthesized (for example by Entelechon, Geneart or Sigma-Genosys) and is provided in the pCR 4 vector (invitrogen). The pCR 4 vector encoding the TeNT LC is cleaved with BamHI and SalI. The BamHI-SalI fragment is then inserted into the LC/A-dynorphin-$H_N$/A vector (SEQ ID NO:102) that has also been cleaved by BamHI and SalI. The final construct contains the TeNT LC-linker-dynorphin-spacer-$H_N$ ORF sequences for expression as a protein of the sequence illustrated in SEQ ID NO:109.

Example 54

Preparation and Purification of an LC/A-dynorphin-$H_N$/A Fusion Protein Family with Variable Dynorphin Ligands Using the same strategy as employed in Example 48, a range of DNA Dynorphin ligands were prepared that encoded various dynorphin ligands. Using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-dynorphin ligand-NheI-spacer-SpeI-PstI-XbaI-stop codon-HindIII. It is important to ensure the correct reading frame is maintained for the spacer, dynorphin ligand and restriction sequences and that the XbaI sequence is not preceded by the bases, TC which would result on DAM methylation. The DNA sequence is screened for restriction sequence incorporation and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, 13 Sep. 2004). This optimised DNA sequence is then commercially synthesized (for example by Entelechon, Geneart or Sigma-Genosys) and is provided in the pCR 4 vector.

Alternatively, the dynorphin ligand was created by performing site-directed mutagenesis on the DNA sequence of LC/A-CPDY-HN/A fusion (SEQ ID NO102).

The ligands that were created included:

| Dynorphin Ligand | Protein sequence of the Dynorphin ligands | SEQ ID NO of the Dynorphin ligand |
|---|---|---|
| CPDY1-13 | YGGFLRRIRPKLK | 113 |
| CPDY(D15A) | YGGFLRRIRPKLKWANQ | 114 |
| CPDY (18RP10R)1-13 | YGGFLRRIRPKLK | 118 |
| CPDY(I8RP1-RD15A) | YGGFLRRRRRKLKWANQ | 117 |
| CPDNv9 | YGGFLGARKSARKRKNQ | 119 |

By way of example, in order to create the LC/A-CPDY (D15A)-GS20-$H_N$/A fusion construct (SEQ ID NO114), the pCR 4 vector encoding the fusion protein (SEQ ID NO102) serves as a template for site-directed mutagenesis to mutate the aspartic acid residue at position 15 within the dynorphin ligand to alanine. A forward and reverse primer was designed and synthesised that were complementary to the template DNA apart but encoded a mismatch to incorporate the required mutation. 125 ng primers, 1 μl dNTPs, 5-50 ng template DNA, 5 μl of 10× reaction buffer and 1μ Pfu polymerase (2.5 U/μl) were added to a 50 μl reaction mixture. The PCR reaction was as follows: 95° C. for 2 min, then 24 cycles of 95° C. for 1 min, 55° C. annealing for 1 min, 68° C. final extension for 8 min, then a 4° C. hold. The DNA product was then transformed into TOP10 cells and the plasmid DNA from the resulting colonies was then purified and sequenced to confirm that the dynorphin ligand had been mutated to create a DNA construct that will give the ORF LC/A-CPDY (D15A)-GS20-$H_N$/A (SEQ ID NO 114).

Purification of Purification of an LC/A-dynorphin-$H_N$/A Fusion Protein Family with Variable Dynorphin Ligands Defrost falcon tube containing 25 ml 50 mM HEPES pH 7.2, 200 mM NaCl and approximately 10 g of *E. coli* BL21 cell paste. Make the thawed cell paste up to 80 ml with 50 mM HEPES pH 7.2, 200 mM NaCl and The cell paste was then homogenised at 20,000 psi by a Constant System Homogeniser. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2, 200 mM NaCl. Using a step gradient of 10 and 40 mM imidazol, wash away the non-specific bound protein and elute the fusion protein with 100 mM imidazol. Dialyse the eluted fusion protein against 5 L of 50 mM HEPES pH 7.2, 200 mM NaCl at 4° C. overnight and measure the OD of the dialysed fusion protein. Add 3.2 μl of enterokinase (2 μg/ml) per 1 mg fusion protein and Incubate at 25° C. static overnight. Activated samples were then subjected to hydrophobic interaction chromatography (HIC purification). Solid ammonium sulphate was slowly added by spatula to the activated fusion protein and stirred by a magnetic flea at room temperature to dissolve the solid. More ammonium sulphate was added once the previous addition had been dissolved and this was repeated until the concentration reached 1 M. Load onto a Phenyl sepharose 6 fast flow (20-30 ml column is sufficient) equilibrated with 50 mM HEPES pH 7.2, 1 M ammonium sulphate. The column was then washed with 50 mM hepes pH 7.2, 1 M ammonium sulphate. Bound protein was eluted by reducing the ammonium sulphate concentration to 0.7 M, 0.5 M, 0.3 M and 0 M and collected in 10 ml fractions. Dialyse the eluted fusion protein against 10 L of 50 mM HEPES pH 7.2, 200 mM NaCl at 4° C. overnight and concentrate the fusion to about 2 mg/ml, aliquot sample and freeze at −20° C. Test purified protein using OD, BCA, purity analysis and SNAP-25 assessments.

Example 55

Preparation and Purification of an LC/A-dynorphin1-13-$H_N$/A (GS30) and LC/A-dynorphin1(D15A)-$H_N$/A (GS30) Fusion Protein Using the constructs described in Examples 48 and Example 54, LC/A-dynorphin1-13-$H_N$/A (GS30) and LC/A-dynorphin1(D15A)-$H_N$/A (GS30) DNA encoding fusion proteins (SEQ ID NOs 116 and 115) were created by sub-cloning experiments. By way of an example, the DNA encoding LC/A-dynorphin1(D15A)-HN/A fusion protein (SEQ ID NO 114) was digested with the restriction enzymes NheI and HindIII to remove the GS20 spacer and heavy chain. DNA encoding LC/A-dynorphin-HN/A (GS30) fusion protein (SEQ ID NO 110) was also digested with NheI and HindIII to produce a GS30-$H_N$/A fragment. Vector backbone and fragment DNA was separated by running on a 1% agroase gel at 150 volts for 1 hour before the DNA was purified with a gel extraction kit. The GS30-$H_N$/A fragment was then ligated into the vector backbone of digested LC/A-dynorphin1 (D15A)-$H_N$/A fusion protein (SEQ ID NO 114) to produce LC/A-dynorphin1(D15A)-$H_N$/A (GS30) fusion protein. Typical ligation reactions were set up as follows: 2 μl Vector DNA, 14 μl Insert DNA, 2 μl 10× T4 ligase buffer, 2 μl T4 ligase. Ligation reactions were left overnight at 16° C.

Purification of LC/A-Dynorphin1-13-$H_N$/A (GS30) and LC/A-dynorphin1(D15A)-$H_N$/A (GS30) Fusion Protein The fusion proteins were purified as described in Example 54.

Example 56

Preparation of a LC/B-dynorphin-$H_N$/B Fusion Protein with a Serotype A Activation Sequence Following the methods used in Examples 18 and 19, the LC/B (SEQ ID NO29) and $H_N$/B (SEQ ID NO30) were created and inserted into the A serotype linker arranged as BamHI-SalI-linker-protease site-dynorphin-NheI-spacer-SpeI-PstI-XbaI-stop codon-HindIII. The final construct contained the LB-linker-dynorphin-spacer-$H_N$/B ORF for expression as a protein of the sequence illustrated in SEQ ID NO112.

Example 57

Construction of CHO-K1 MrgX1 Receptor Activation Ca2+ Fluorimetry Assay

Cell-Line Culture

CHO-K1 MrgX1 Cell Line cells were purchased from Perkin Elmer (Perkin Elmer ES-740-A). Cell culture media used was F-12 HAMS+Glutamax with 10% Foetal bovine serum and 800 μg/ml Geneticin. Cells were grown in continuous culture in T500 flasks. Subconfluent cultures (70-80%) confluent were split at a ratio 1:40 every 3-4 days. Then the culture medium was removed from the cells and the cells washed twice with 30 mL PBS. Cells were then removed from the flask by addition of 30 ml of PBS-based enzyme free dissociation buffer, and incubated at 37 C for 5 min followed by gentle tapping of the flasks to dislodge cells. Added 10-20 mL of culture media to the flasks and transferred the remaining cells to a 50 ml tube. Washed the flask with 10-20 ml culture media and added this to the cell suspension. Cells were then centrifuged at 1300 rpm for 3 min in a Heraeus megafuge 1.0 to pellet cells before removing the supernatant and resuspending the cell pellet in culture media. Cells were then diluted further with culture media to achieve a split ratio of 1:40 and transferred appropriate volume of cells to a T500 flask. The number of cells present were counted using the Nucleocounter. Cells were then pelleted by centrifugation at 1,300 rpm for 3 min in a Heraeus megafuge 1.0 and the pellet re-suspend in Bambanker freezing medium to achieve a concentration of 3×106 cells·mL−1. After aliquoting the cell suspension into 1.8 mL Nunc cryovials, the vials were transferred to a cryo vial rack and store at −80° C. overnight before transferring the vials to the short-term liquid nitrogen store. Several cell passage numbers were frozen in liquid nitrogen for use in the assay. Maximum passage number to be used in the assay is Px+16.

Resurrection and Plating CHO-K1-MrgX1 Cells

This assay was optimized for the use of frozen cells. Plated cells ~16 h before the assay performed. Removed cell vials from liquid nitrogen and thawed quickly by placing vials in a 37° C. water bath. Transferred cells to a centrifuge tube containing 10 ml growth media for each vial being resurrected. Pelleted the cells by centrifuging at 1,300 rpm for 3 min in a Heraeus megafuge 1.0. Then the cell pellet was re-suspend in 2 mL media/vial and the number of viable cells in the suspension counted using a Nucleocounter before adding media to the cell suspension to achieve a cell concentration of 1×106 cells·mL−1. Then the cells were plated in a Corning black walled, clear-bottom, half-area plate at a density of 20,000 viable cells·well−1 by using a Rainin E8-300 multi-channel pipette to firstly add 30 μL media to each well followed by 20 μL·well−1 of the 1×106 cells·mL−1 cell suspension. Cells were plated 16-18 h prior to the beginning of the assay and the plates maintain under normal growth conditions in a 37° C. 5% $CO_2$ incubator.

HBSS Assay Buffer Preparation

Added 1.26 mmol·$L^{-1}$ $CaCl_2$ (630 μL of 1 mol·$L^{-1}$ CaCl2), 0.49 mmol·$L^{-1}$ $MgCl_2$ (245 μL of 1 mol·$L^{-1}$ $MgCl_2$), 0.4 mmol·$L^{-1}$ $MgSO_4$ (203 μL of 1 mol·L−1 $MgSO_4$), 20 mmol·$L^{-1}$ HEPES (10 mL of 1 mol·$L^{-1}$ HEPES) to 500 mL HBSS. Adjust the pH of the HBSS buffer to pH 7.4 at room temperature using NaOH. Filter sterilise the HBSS buffer in a sterile hood. On the day of the assay, prepared a fresh stock of Probenecid at 500 mmol·L−1 by dissolving 710 mg of probenecid (MW: 285.36) in 5 mL of 1 mol·L−1 NaOH. Assay buffer was made by adding the appropriate volume of 500 mmol·$L^{-1}$ probenecid to HBSS buffer required for the assay plate (final concentration, 5 mmol·$L^{-1}$) and the ligand dilution series (2.5 mmol·$L^{-1}$ final concentration). To the 5 mmol·$L^{-1}$ probenecid/HBSS assay buffer added a volume of 10% BSA that gives a final concentration of 0.02° A) BSA. Used the same solution of 5 mmol·$L^{-1}$ probenecid/0.02% BSA assay buffer to dilute 1 in 2 in HBSS to make a 2.5 mmol·L−1 probenecid/0.01% BSA solution for ligand dilution.

Calcium-3 Dye Preparation

Added 10 mL HBSS buffer to a bottle of desiccated $Ca^{2+}$-4 dye. Vortexed hard and transfer to a 100 mL container. Repeated this 9 times so that a total of 100 mL HBSS buffer had been added to the $Ca^{2+-}$4 dye. Aliquoted the dye into 10 mL aliquots and stored at −20° C. When using a frozen aliquot, the vial was removed from −20° C. freezer and warmed in a 37° C. waterbath. After thawing the necessary number of vials of $Ca^{2+}$–4 dye, it was diluted 1:2 with HBSS buffer to attain 0.5×$Ca^{2+}$-4 dye.

Dilution of Test Fusions

Prepared the source plate, containing ligand or fusion, prior to loading cells and beginning their incubation. All reference ligand concentration ranges were achieved by serial dilution in half-log 10 increments using Sigmacoted tips. The reference compound BAM (8-22) was included in every assay at a concentration range of 5×$10^{-6}$M (5 μM) to 5×10−11 M (50 pM) (final assay concentration will be 5× lower) plus basal (1×10−14). Fusions to be tested were included in every assay at a concentration range of 5×10−6 M to 5×10−9 M (final assay concentration will be 5× lower).

Prepared an intermediate 50 μmol·L−1 stock of BAM (8-22) by 1 in 10 dilution in HBSS assay buffer (2.5 mmol·L−1 probenecid; 0.01% BSA HBSS assay buffer) of 500 μmol·L-1 stock using lo-bind Eppendorf tubes and Gilson P20 and P100 pipettes. Then, transfer 50 μL of the 50 μmol·L−1 intermediate stock to the first well of a 0.5 mL lo-bind 96-well plate containing 450 μL of HBSS buffer and performed the ligand dilution series creating 1:10 dilution series going down the plate.

The assay was optimized for the source plate layout in rows, therefore source the dilution series must be split into triplicates (minimum of 50 μL to allow FlexStation3 to transfer 25 μL) in a separate 0.5 mL lo-bind 96-well plate (×2 compounds per plate). This can be transferred directly to the FlexStation3 for ligand transfer using Sigmacoted FlexStation3 tips (Molecular Devices).

Dye Lading of Cells

Removed culture media from the half area 96-well plates containing cells, incubated overnight using a Rainin L50 pipette, taking care not to disrupt cells. Add 50 μL of assay buffer followed by 50 μL of 0.5×Ca2+ dye using an electronic multichannel pipette E8-300. Incubate cells at 37° C. in 5% CO2 for 120 min.

FLEXSTATION3 Readings

The human mas-related G-protein coupled receptor member X1 belongs to the family of orphan G protein-coupled receptors. Predominantly coupled through Gαq/11, receptor activation by an agonist causes Gag protein activation resulting in $Ca^{2+}$ release from intracellular stores that is mediated by the target enzyme phospholipase Cβ. The transient increase in intracellular $Ca^{2+}$ requires a real-time (RT), simultaneous inject-and-read system to measure $Ca^{2+}$ flux. The FlexStation3 microplate reader with integrated fluid transfer is used in this assay for this purpose. CHO cells that express the recombinant human MrgX1 receptor are incubated with the proprietary FLIPR-Calcium-4 masking dye that minimises background signal from extracellular $Ca^{2+}$ and makes washing cells unnecessary. The $Ca^{2+}$-4 dye forms a complex with $Ca^{2+}$ which fluoresces at 525 nm following excitation at 485 nm allowing signal-detection. An inhibitor of cell membrane anion exchanger, probenecid, is included in the assay buffer to prevent outward transport or sequestration of dye molecules. Following incubation with the dye, the cell plate is loaded onto to the FlexStation3 which transfers ligands (reference agonist or fusions) from a source plate into the microplate wells containing cells. The FlexStation 3 measures the fluorescent-emission from the Calcium-4 dye and readouts are formed as calcium traces displaying the magnitude of calcium flux as a result of MrgX1 receptor activation.

Example 58

Construction and Activation of BAM Fusion Proteins

To construct fusions that contain BAM1-22 (SEQ ID NO120) and BAMS-22 (SEQ ID NO121) the preparation of a LC/A and $H_N$/A backbone clones and preparation of cloning and expression vectors are identical as those described in Example 48.

Preparation of Linker-BAM-Spacer Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGIITSKTKSLDKGYNKALNDL. Within this sequence, it is understood that proteolytic activation in nature leads to an $H_N$ domain that has an N-terminus of the sequence ALNDL. This sequence information is freely available from available database sources such as GenBank (accession number P10845) or Swissprot (accession locus BXA1_CLOBO). Into this linker an enterokinase site, BAM ligand (SEQ ID NO 120 or SEQ ID NO 121) and spacer are incorporated; and using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-Sail-linker-protease site-BAM(1-22) or BAM(8-22) ligand-NheI-spacer-SpeI-PstI-XbaI-stop codon-HindIII. It is important to ensure the correct reading frame is maintained for the spacer, dynorphin and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example by Entelechon, Geneart or Sigma-Genosys) and is provided in the pCR 4 vector.

Preparation of the LC/A-BAM(1-22)-$H_N$/A Fusion

In order to create the LC-linker-BAM(1-22)-spacer-$H_N$/A construct (SEQ ID NO122), the pCR 4 vector encoding the linker-BAM(1-22)-spacer insert is cleaved with BamHI+SalI restriction enzymes. This cleaved vector then serves as the recipient vector for insertion and ligation of the LC/A DNA (SEQ ID NO27) cleaved with BamHI+SalI. The resulting plasmid DNA is then cleaved with PstI+XbaI restriction enzymes and serves as the recipient vector for the insertion and ligation of the $H_N$/A DNA (SEQ ID NO28) cleaved with PstI+XbaI. The final construct contains the LC-linker-BAM (1-22)-spacer-$H_N$/A ORF (SEQ ID NO122) for transfer into expression vectors for expression to result in a fusion protein of the sequence illustrated in SEQ ID NO123.

Preparation of the LC/A-BAM(8-22)-$H_N$/A Fusion

In order to create the LC-linker-BAM(8-22)-spacer-$H_N$/A construct, the pCR 4 vector encoding the linker-BAM(8-22)-spacer insert is cleaved with BamHI+SalI restriction enzymes. This cleaved vector then serves as the recipient vector for insertion and ligation of the LC/A DNA (SEQ ID NO27) cleaved with BamHI+SalI. The resulting plasmid DNA is then cleaved with PstI+XbaI restriction enzymes and serves as the recipient vector for the insertion and ligation of the $H_N$/A DNA (SEQ ID NO28) cleaved with PstI+XbaI. The final construct contains the LC-linker-BAM(8-22)-spacer-$H_N$/A ORF for transfer into expression vectors for expression to result in a fusion protein of the sequence illustrated in SEQ ID NO125.

Preparation of Linker-spacer-BAM8-22 Insert

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) is 23 amino acids long and has the sequence VRGI-ITSKTKSLDKGYNKALNDL. Within this sequence, it is understood that proteolytic activation in nature leads to an $H_N$ domain that has an N-terminus of the sequence ALNDL. This sequence information is freely available from available database sources such as GenBank (accession number P10845) or Swissprot (accession locus BXA1_CLOBO). Into this linker an enterokinase site is incorporated; and using one of a variety of reverse translation software tools [for example EditSeq best *E. coli* reverse translation (DNASTAR Inc.), or Backtranslation tool v2.0 (Entelechon)], the DNA sequence encoding the linker-ligand-spacer region is determined. Restriction sites are then incorporated into the DNA sequence and can be arranged as BamHI-SalI-linker-protease site-PstI-XbaI-spacer-SpeI-BAM8-22-stop codon-HindIII. It is important to ensure the correct reading frame is maintained for the spacer, BAM and restriction sequences and that the XbaI sequence is not preceded by the bases, TC, which would result on DAM methylation. The DNA sequence is screened for restriction sequence incorporation, and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example, GenBank Release 143, 13 Sep. 2004). This optimised DNA sequence is then commercially synthesized (for example by Entelechon, Geneart or Sigma-Genosys) and is provided in the pCR 4 vector.

Preparation of the LC/A-HN/A-BAM(8-22) Fusion

In order to create the LC/A-$H_N$/A-BAM(8-22) construct, the pCR 4 vector encoding the linker-spacer-BAM(1-22) insert is cleaved with BamHI+SalI restriction enzymes. This cleaved vector then serves as the recipient vector for insertion and ligation of the LC/A DNA (SEQ ID NO27) cleaved with BamHI+SalI. The resulting plasmid DNA is then cleaved with PstI+XbaI restriction enzymes and serves as the recipient vector for the insertion and ligation of the $H_N$/A DNA (SEQ ID NO28) cleaved with PstI+XbaI. The final construct contains the LC/A-linker-protease site-$H_N$/A-spacer-SpeI-BAMS-22 ORF for transfer into expression vectors for expression to result in a fusion protein of the sequence illustrated in SEQ ID NO124.

Purification Method for BAM Fusion Proteins

The fusion proteins were purified as described in Example 54.

Example 59

Construction of CHO-K1 OPRM1 Binding Assay and NCI-H69 SNAP-25 Cleavage Assay A radioligand binding assay for measurement of the binding affinity ($pK_I$) of a range of reference ligands and fusions to human β-opioid ($OP_3$) receptors in CHO cells stably transfected with the human β-opioid receptors (CHO-MOR cells) was used. The assay involves the specific labelling of μ-opioid receptors (MOR) expressed in CHO cells with the MOR selective agonist radioligand [$^3$H]-DAMGO. Increasing amounts of unlabelled competing ligand (Syntaxin ligands or reference compounds) are incubated with a fixed amount of radioligand and cell membranes. Upon completion of the assay, reaction mixtures are filtered through glass fibre paper where radioactivity associated with MOR receptors becomes trapped. The radioactivity of each filter is quantified and this relates to the ability of the competing ligand to bind to the MOR receptor in place of the radioligand. Ligands better able to bind to the MOR receptor will appear to 'displace' the radiolabel at lower concentrations.

Cell Culture

CHO-MOR cells (CHO-K1 cells with stable expression of the μ (OP3) Perkin Elmer ES-542-C) were cultured according to the supplier's recommendations. Cells were grown in Hams F12 containing 10% FBS and 400 μg/ml G418 at 37° C. in an atmosphere of 95% $O_2$/5% $CO_2$. Cells were passaged when cells had reached 80% confluency, typically every 3-4 days.

Cells were grown in eight T175 flasks to ~80% confluence, the culture medium was removed and the cells washed twice with 10-20 ml PBS. Cells were removed from the flask by addition of 5 ml of PBS based enzyme free dissociation buffer, and incubated at 37° C. for 10 min followed by gentle tapping of the flasks to dislodged cells. Ten ml of culture media was added to the flasks and the cells were transferred to a 50 ml Falcon tube. Flasks were washed with a further 20 ml culture media which was then added to the cell suspension. Cells were centrifuged (1300×g, 3 min), the supernatant removed, and the cell pellet resuspended in culture media by trituration. A cell sample was removed and the viable cell number calculated using a nucleocounter (ChemoMetec). The volume of media was adjusted to give a final concentration of $5\times10^6$ cells/ml. One ml aliquots of the resultant cell suspension were transferred to 1.5 ml microfuge tubes and centrifuged (100×g, 5 min), the supernatant was removed and the cell pellets frozen and stored at −80° C.

Membrane Preparation

On the day of the assay, the required number of cell pellets was removed from −80° C. and 1 ml ice cold membrane preparation buffer (50 mM Tris pH 7.4 at 4° C.) was added to each pellet. Individual cell pellets were dislodged by vortexing, collected into a 40 ml centrifuge tube and the total volumes adjusted to 10 ml. Cells were homogenised (1×1 s) using an Ultra Turrax T25-digital homogeniser (IKA- WERKE), at the highest setting (25,000 $min^{-1}$). Membranes were diluted to the required cell concentrations in Assay Buffer (50 mM Tris pH 6.96 at 21° C.) by counting the total cells in a Nucleocounter and make to 300,000 cells/ml.

Competition Binding Assay

In order to determine the binding profile of a number of β-opioid receptor ligands or fusions, competition binding assays were performed in which a fixed concentration of [$^3$H]-DAMGO was competed with increasing concentrations of the β-opioid receptor ligands or fusion protein. CHO-MOR cell membranes (equivalent to 30,000 cells per well) were incubated with a fixed concentration of [$^3$H]-DAMGO (1 nM) and increasing concentrations of competing ligand or fusion (0.01 nM to 1 μM), in Assay Buffer (50 mM Tris pH 6.96 at 21° C.). To define the non-specific and total binding, each reaction was performed in the presence or absence of CTOP (1 μM). Reactions were performed, in triplicate, in deep-well 'LoBind Protein' 96-well plates (200 μl final volume) and initiated by addition of cell membranes. Assay plates were mixed, covered with a plate sealer and incubated for 1 hr at room temperature. Reactions were terminated by rapid filtration through Whatman GF/B filters using a Brandel cell harvester, filters were washed (3×3 ml) with ice-cold wash buffer (50 mM Tris-HCl, pH 7.4 at 4° C.) and transferred to scintillation vials. Scintillation fluid was added to each vial and after 3 hours bound radioactivity was quantified in a Tri-Carb 2900TR liquid scintillation analyser by counting each vial for 3 min.

NCI-H69 SNAP-25 Cleavage Assay

SNARE cleavage by betaendorphin fusions was demonstrated by developing a NCI-H69 SNAP-25 cleavage assay. This assay used the human small cell lung carcinoma cell line NCI-H69.

H69 cells were plated into poly-D-Lysine coated 96 well plates at 4×$10^5$ cells/ml. The plates were left for 24-48 hours prior to treatment. H69 feeding Medium consisted of RPMI-1640 containing 10% FBS, 4.5 g/l Glucose, 1.5 g/l Sodium bicarbonate, 1 mM Sodium Pyruvate, 10 mM HEPES, 2 mM Glutamine. 50 ml of cell media was filtered sterilised into a sterile 50 ml centrifuge tube using a syringe and 0.2 um filter to be used to create two separate dilutions series for each TSI, with starting points at half log intervals (starting at 1 uM and 300 nM). The two resulting series were then combined into one dose curve. Each concentration was plated in triplicate across the plate with a dose curve running down the plate. By removing 125 ul media from the cell plate to be treated and adding 125 ul of each TSI solution to the well. Then the plate was placed in an incubator at 37° C., 5% $CO_2$ for 24 hours. After 24 hours, test materials/feeding medium was removed from the plate by inverting over a waste receptacle and the remaining media from each well was removed using a fine-tipped pastette. Next, the cells were lysed using Lysis buffer (25% 4× NuPAGE LDS sample buffer, 10% 1M DTT, 65% dH2O); 100 μl lysis buffer was added to each well, and the plate left at room temperature for 5 minutes. Then the lysate was transferred from each well into a 1.5 mL microcentrifuge tube using a Gilson P200 pipette and placed in a heat block pre-warmed to 90° C. for 10 minutes. SNAP-25 cleavage was then determined by western blotting with a SNAP-25 antibody. 15 μL of lysed samples and 3 μL Invitrogen Magic Marker XP (LC5602) & 3 μL Invitrogen See Blue Plus 2 pre-stained standard (LC5925) was loaded onto Invitrogen 12% bis-tris 1 mm, 15 well gels that were immersed in Invitrogen NuPAGE MOPS SDS Running Buffer. The gel was then run at 200 V until the Lysozyme 14 kDa marker is just above the gel base (approximately 70 minutes). Transferred proteins from the gel to a nitrocellulose membrane on an iBlot dry blotting system from invitrogen (IB1001UK), on program 2 (23 volts) for 6 minutes, according to the manufacturers instructions. On completion of the iBlot program, the membrane was to removed from the transfer stack and placed in a small tray containing blocking buffer (5 g Marvel milk powder per 100 mL PBS/Tween 0.1%). The membrane was then incubated with blocking buffer solution at room temperature, on a rocker, for 60 minutes. After blocking, the primary antibody solution was added to the blocking buffer and membrane; 10μ Anti-SNAP-25 (Sigma S-9684) added per 10 mL blocking buffer (1:1000 dilution). Sigma's anti-SNAP-25 is reactive toward the whole SNAP-25 protein so it therefore recognizes the intact and cleaved SNAP-25. Membranes were incubated with primary antibody at room temperature, on a rocker, for 60 minutes. Then the membranes were washed by performing 3 rinses with PBS/Tween 0.1% and further blocking buffer added before incubating the membranes at room temperature, on a rocker, for 10 minutes. After incubation in blocking buffer the secondary antibody was added to the membrane; 20 μl of Anti-Rabbit-HRP conjugate (Sigma A-6154) was added per 40 mL blocking buffer (1:2000 dilution). The membrane was incubate with secondary antibody at room temperature, on a rocker, for 60 minutes before being washed three times with PBS/Tween (0.1%). Again, further blocking buffer was added to the membrane and the membrane incubated at room temperature, on a rocker, for 30 minutes before being washed 3 times with PBS/Tween (0.1%). Finally, detection of bound antibody solution done using Pierce West-Dura supersignal (34075) detection reagents. The detection reagents were mixed (Luminol/Enhancer Solution, Stable Peroxide Buffer) at a 1:1 ratio (a total volume of 2 ml per mini membrane) and applied to the membrane, ensuring that the membrane is completely flat and the reagents cover it completely. The membrane was incubated for 5 minutes at room temperature before Chemiluminescent detection was performed on the GeneGnome HR Syngene system from Synoptics. The exposure was set to 5 minutes and Gene tools software from Syngene was used to calculate the relative amounts of cleaved and uncleaved SNAP-25 within each lane.

Example 60

Construction of CHO-K1 $BDKRB_1$ and CHO-K1 $BDKRB_2$ Receptor Activation Assay CHO-K1 $BDKB_2$ Receptor Activation Assay A receptor activation assay was developed for which stably transfected CHO-K1 cells with the $B_2$ receptor were used in a calcium fluorimetry assay measuring intracellular calcium levels. The assay allowed the measurement of the potency ($pEC_{50}$) and intrinsic efficacy ($E_{max}$) of the bradykinin ligand and fusions. The assay involves indirect measurement of $B_2$-receptor activation by measuring changes in intracellular calcium levels using a Flexstation3 and calcium-sensitive dye.

Culture of CHO-K1 B2 Cells

CHO-K1 cells with stable expression of the $B_2$ receptor (CHO-K1-$B_2$-R; ES-090-C) were purchased from Perkin Elmer. Cells were cultured in Ham's F12 containing 2 mM glutamine, 10% FBS and 400 μg/ml G418 at 37° C. in a humidified environment containing 5% $CO_2$. Cells were passaged every 3 to 5 days when cells were ~80% confluent. The media was removed and the cells washed twice with PBS. Cells were harvested using a PBS-based non-enzymatic cell dissociation buffer at 37° C. for 2-3 minutes, pelleted by centrifugation, resuspended in culture media and seeded into fresh T175 flasks.

Seeding of CHO-K1 B2 Cells

Cells were harvested using a PBS-based non-enzymatic cell dissociation buffer at 37° C. for 2-3 minutes. Cells were collected by centrifugation, resuspended in culture media and the cell concentration determined using a nucleocounter (ChemoMetec). Cells were diluted in culture media to the required concentration of 2×105 cells $ml^{-1}$ and seeded into 96-well plates at a volume of 100 μl per well. Cells were incubated at 37° C. in 5% $CO_2$ overnight.

Estimation of Potency and Intrinsic Activity of Bradykinin and BK Fusions

The following day after seeding, culture media was removed from the cells and replaced with 100 μl per well of assay buffer (HBSS with 1.26 mM $CaCl_2$, 0.49 mM $MgCl_2$, 0.4 mM $MgSO_4$ and 20 mM HEPES at pH 7.4) containing 5 mM probenecid (probenecid final concentration of 2.5 mM) and FLIPR calcium 4 loading dye (100 μl). Cells were incubated at 37° C. in 5% $CO_2$ for 60 min after which increasing concentrations of bradykinin (50 μl) or fusion protein were added to the cells in triplicate by the Flexstation3. The change in fluorescent emission at 525 nm following excitation at 485 nm was determined over a 70 s time period using the FlexStation3.

CHO-K1 BDKB$_1$ Receptor Activation Assay

An assay was also developed to allow the measurement of potency ($pEC_{50}$) and efficacy (Emax) of bradykinin ligands at the human bradykinin $B_1$ receptor stably expressed in CHO-K1 cells. This assay was similar to the $B_2$ receptor activation assay as it measured is the changes in intracellular calcium levels using a calcium fluorimetry assay. CHO-K1 cells with stable expression of the $B_1$ receptor were purchased from Perkin Elmer (ES-091-C).

Culture of CHO-K1 B1 Cells

CHO-K1 cells with stable expression of the human B1 receptor (CHO-K1-B1 cells) were cultured in culture media (Ham's F12 containing 2 mM glutamine, 10% FBS and 400 μg·ml−1 G418) at 37° C. in a humidified environment containing 5% $CO_2$. Cells were passaged every 3 to 5 days when cells were ~80% confluent. The media was removed and the cells washed twice with PBS. Cells were harvested using a PBS-based non-enzymatic cell dissociation buffer at 37° C. for 2-3 min, pelleted by centrifugation (1,500 rpm; 3 min), re-suspended in culture media and seeded into fresh T500 flasks. Pellet cells by centrifugation at 1,300 rpm for 3 min in a Hereaus megafuge 1.0. Then the cell pellet was resuspended in Bambanker freezing medium to achieve a concentration of $3\times10^6$ cells·$mL^{-1}$ and aliquoted into 1.8 mL Nunc cryovials. The cryovials were transferred to a cryo vial rack and stored at −80° C. overnight before transferring the vials to the short-term liquid nitrogen store.

Seeding of CHO-K1 B1 Cells

The day before the assay, cell vials were removed from the liquid nitrogen store and thawed quickly by placing vials in a 37° C. water bath. Cells were then pelleted by centrifuging at 1,300 rpm for 3 min in a Hereaus megafuge 1.0. The cell pellet was re-suspend in 2 mL media/vial and the number of viable cells in the suspension counted using the Nucleocounter. Added media to the cell suspension to achieve a cell concentration of $1\times10^6$ cells·mL¯1. Then the cells were plated in a Corning black walled, clear-bottom, half-area plate at a density of 20,000 viable cells·$well^{-1}$; using a Rainin E8-300 multi-channel pipette added 30 μL media to each well followed by 20 μL·$well^{-1}$ of the $1\times10^6$ cells·$mL^{-1}$ cell suspension. Maintained the plates overnight at 37° C. in a humidified environment containing 5% $CO_2$.

Estimation of Potency and Intrinsic Activity of des-Arg Bradykinin and BK Fusions Next day the plates were incubated (37° C. in a humidified environment containing 5% $CO_2$) in HBSS modified assay buffer (with 1.26 mM $CaCl_2$, 0.49 mM $MgCl_2$, 0.4 mM $MgSO_4$ and 20 mM HEPES at pH 7.4) containing x0.5 $Ca^{2+}$-dye, probenecid (2.5 mM). After 1 hour, increasing concentrations of des-Arg$^9$-BK and fusion proteins were added to the cells in triplicate rows by the FlexStation3® (height 70 μl; speed 16 μl·$s^{-1}$; 37° C.). The fluorescence emitted at 525 nm was measured over a 60 s time period and expressed as % increase in baseline RFU.

Example 61

Construction and Activation of Bradykinin Fusion Proteins

Following the methods used in Examples 18 and 19, the LC/A (SEQ ID NO27) and $H_N$/A (SEQ ID NO28) were created and inserted into the A serotype bradykinin linker arranged as BamHI-SalI-linker-protease site-PstI-XbaI-spacer-SpeI-bradykinin-stop codon-HindIII. The final construct contained the LC/A-linker-protease site-HN/A-spacer-SpeI-Bradykinin ORF (SEQ ID NO 131) for expression as a protein of the sequence illustrated in SEQ ID NO132.

Alternatively, the bradykinin (SEQ ID NO129) in the bradykinin linker was replaced by des Arg$^9$-bradykinin (SEQ ID NO 130) so that the final construct contained the LC/A-linker-protease site-HN/A-spacer-SpeI-des Arg$^9$-Bradykinin ORF for expression as a protein of the sequence illustrated in SEQ ID NO133.

Purification Method for Bradykinin Fusion Proteins

The fusion proteins were purified as described in Example 54.

Example 62

Construction and Activation of Substance P Fusion Proteins

Following the methods used in Examples 18 and 19, the LC/A (SEQ ID NO27) and $H_N$/A (SEQ ID NO28) are created and inserted into the A serotype substance P analogue (S6) linker arranged as BamHI-Sail-linker-protease site-PstI-XbaI-spacer-SpeI-substance P (S6)-stop codon-HindIII. The final construct contains the LC/A-linker-protease site-HN/A-spacer-SpeI-substance P(S6) ORF for expression as a protein of the sequence illustrated in SEQ ID NO136.

Purification Method for Substance P Fusion Proteins

The fusion proteins were purified as described in Example 54.

Example 63

A method of treating, preventing or ameliorating pain in a subject, comprising administration to said patient a therapeutic effective amount of non-cytotoxic protein conjugate, wherein said pain is selected from the group consisting of: chronic pain arising from malignant disease, chronic pain not caused by malignant disease (peripheral neuropathies).

Patient A

A 73 year old woman suffering from severe pain caused by posthepatic neuralgia is treated by a peripheral injection with non-cytotoxic protein conjugate to reduce neurotransmitter release at the synapse of nerve terminals to reduce the pain. The patient experiences good analgesic effect within 2 hours of said injection.

Patient B

A 32 year old male suffering from phantom limb pain after having his left arm amputated following a car accident is treated by peripheral injection with non-cytotoxic protein conjugate to reduce the pain. The patient experiences good analgesic effect within 1 hour of said injection.

Patient C

A 55 year male suffering from diabetic neuropathy is treated by a peripheral injection with non-cytotoxic protein conjugate to reduce neurotransmitter release at the synapse of nerve terminals to reduce the pain. The patient experiences good analgesic effect within 4 hours of said injection.

Patient D

A 63 year old woman suffering from cancer pain is treated by a peripheral injection with non-cytotoxic protein conjugate to reduce neurotransmitter release at the synapse of nerve terminals to reduce the pain. The patient experiences good analgesic effect within 4 hours of said injection.

All documents, books, manuals, papers, patents, published patent applications, guides, abstracts and other reference materials cited herein are incorporated by reference in their entirety. While the foregoing specification teaches the principles of the present invention, with examples provided for the purpose of illustration, it will be appreciated by one skilled in the art from reading this disclosure that various changes in form and detail can be made without departing from the true scope of the invention.

SEQUENCE LISTING (186 sequences)

SEQ ID NO: 1 - DNA, 51 bp, Artificial Sequence
  Synthetic
tttggcggtttcacgggcgcacgcaaatcagcgcgtaaattagctaaccag

SEQ ID NO: 2 - protein, 17 aa, Artificial Sequence
  Synthetic
FGGFTGARKSARKLANQ

SEQ ID NO: 3 - DNA, 33 bp, Artificial Sequence
  Synthetic
tttggcggtttcacgggcgcacgcaaatcagcg

SEQ ID NO: 4 - protein, 11 aa, Artificial Sequence
  Synthetic
FGGFTGARKSA

SEQ ID NO: 5 - DNA, 33 bp, Artificial Sequence
  Synthetic
tttggcggtttcacgggcgcacgcaaatatgcg

SEQ ID NO: 6 - protein, 11 aa, Artificial Sequence
  Synthetic
FGGFTGARKYA

SEQ ID NO: 7 - DNA, 33 bp, Artificial Sequence
  Synthetic
tttggcggtttcacgggcgcacgcaaatcatat

SEQ ID NO: 8 - protein, 11 aa, Artificial Sequence
  Synthetic
FGGFTGARKSY

SEQ ID NO: 9 - DNA, 51 bp, Artificial Sequence
  Synthetic
tttggcggtttcacgggcgcacgcaaatcagcgcgtaaatatgctaaccag

SEQ ID NO: 10 - protein, 17 aa, Artificial Sequence
  Synthetic
FGGFTGARKSARKYANQ

SEQ ID NO: 11 - DNA, 39 bp, Artificial Sequence
  Synthetic
tttggcggtttcacgggcgcacgcaaatcagcgcgtaaa

SEQ ID NO: 12 - protein, 13 aa, Artificial Sequence
  Synthetic
FGGFTGARKSARK

SEQ ID NO: 13 - DNA, 51 bp, Artificial Sequence
  Synthetic
tttggcggtttcacgggcgcacgcaaatcagcgcgtaaacgcaaaaaccag

SEQ ID NO: 14 - protein, 17 aa, Artificial Sequence
  Synthetic
FGGFTGARKSARKRKNQ

SEQ ID NO: 15 - DNA, 2736 bp, Artificial Sequence
  Synthetic
ctcgggattgagggtcgttttggcggtttcacgggcgcacgcaaatcagcgcgtaaattagctaaccagactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 16 - protein, 911 aa, Artificial Sequence
  Synthetic
LGIEGRFGGFTGARKSARKLANQTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 17 - DNA, 2700 bp, Artificial Sequence
  Synthetic
tttggcggtttcacgggcgcacgcaaatcatatactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 18 - protein, 899 aa, Artificial Sequence
  Synthetic
FGGFTGARKSYTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 19 - DNA, 2706 bp, Artificial Sequence
  Synthetic
tttggcggtttcacgggcgcacgcaaatcagcgcgtaaaactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 20 - protein, 901 aa, Artificial Sequence
  Synthetic
FGGFTGARKSARKTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 21 - DNA, 2691 bp, Artificial Sequence
  Synthetic
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactggcggtgggggtagtggcggtggcggttcgggcgggggtgggagctttggcggtttcacgggcgcacgcaaatcagcgcgtaaattagctaaccag

SEQ ID NO: 22 - protein, 897 aa, Artificial Sequence
  Synthetic
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTGGGGSGGGGSGGGGSFGGFTGARKSARKLANQ

SEQ ID NO: 23 - DNA, 2676 bp, Artificial Sequence
  Synthetic
atgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaatggcggtgggggtagtggcggtggcggttcgggcgggggtgggagctttggcggtttcacgggcgcacgcaaatcagcg

SEQ ID NO: 24 - protein, 892 aa, Artificial Sequence
  Synthetic
MPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNGGGGSGGGGSGGGGSFGGFTGARKSA

SEQ ID NO: 25 - DNA, 2712 bp, Artificial Sequence
  Synthetic
tttggcggtttcacgggcgcacgcaaatcagcgcgtaaatatgctaaccagactagtggcggtgggggtagtggcggtggcggttcgggcgggggtgggagccctaggggatccatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaat

SEQ ID NO: 26 - protein, 904 aa, Artificial Sequence
  Synthetic
FGGFTGARKSARKYANQTSGGGGSGGGGSGGGGSPRGSMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 27 - DNA, 1302 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgac

SEQ ID NO: 28 - DNA, 1257 bp, Artificial Sequence
  Synthetic
ctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactagaagctt

SEQ ID NO: 29 - DNA, 1323 bp, Artificial Sequence
  Synthetic
ggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcgtcgac

SEQ ID NO: 30 - DNA, 1260 bp, Artificial Sequence
  Synthetic
ctgcagtgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaactctctagactagaagctt

SEQ ID NO: 31 - DNA, 1329 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgac

SEQ ID NO: 32 - DNA, 1263 bp, Artificial Sequence
  Synthetic
ctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactagaagctt

SEQ ID NO: 33 - DNA, 207 bp, Artificial Sequence
  Synthetic
ggatccacgcacgtcgacggcatcattacctccaaaactaaatctctgatcgaaggtcgttttggcggtttcacgggcgcacgcaaatcagcgcgtaaattagctaaccaggcgctagcgggcggtggcggtagcggcggtggcggtagcggcggtggcggtagcgcactagtgctgcagacgcacggtctagaatgataaaagctt

SEQ ID NO: 34 - DNA, 108 bp, Artificial Sequence
  Synthetic
ggatccacgcacgtcgacggcatcattacctccaaaactaaatctctgatagaaggtagaaacaaagcgctgaacctgcagacgcacggtctagaatgataaaagctt

SEQ ID NO: 35 - DNA, 186 bp, Artificial Sequence
  Synthetic
catatgaataacctcgggattgagggtcgttttggcggtttcacgggcgcacgcaaatcagcgcgtaaattagctaaccagactagtggcggtgggggtagtggcggtggcggttcgggcgggggtgggagccctaggggatccgtcgacctgcagggtctagaagcgctagcgtgataaaagctt

SEQ ID NO: 36 - DNA, 180 bp, Artificial Sequence
  Synthetic
ggatccacgcacgtcgacgcgattgatggtcgttttggcggtttcacgggcgcacgcaaatcagcgcgtaaattagctaaccaggcgctagcgggcggtggcggtagcggcggtggcggtagcggcggtggcggtagcgcactagtgctgcagacgcacggtctagaatgataaaagctt

SEQ ID NO: 37 - DNA, 249 bp, Artificial Sequence
  Synthetic
ggatccacgcacgtcgacggcatcattacctccaaaactaaatctctgatcgaaggtcgttacggtggtttcatgacctctgaaaaatctcagaccccgctggttaccctgttcaaaaacgctatcatcaaaaacgcttacaaaaaaggtgaagcgctagcgggtggtggtggttctggtggtggtggttctggtggtggtggttctgcactagtgctgcagacgcacggtctagaatgataaaagctt

SEQ ID NO: 38 - DNA, 207 bp, Artificial Sequence
  Synthetic
ggatccacgcacgtcgacggcatcattacctccaaaactaaatctctgatcgaaggtcgttttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 39 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 40 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 41 - DNA, 2736 bp, Artificial Sequence; identical to SEQ ID NO: 15
  Synthetic

SEQ ID NO: 42 - protein, 911 aa, Artificial Sequence; identical to SEQ ID NO: 16
  Synthetic

SEQ ID NO: 43 - DNA, 2715 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgatagatggtagatttggcggtttcacgggcgcacgcaaatcagcgcgtaaattagctaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 44 - protein, 904 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRFGGFTGARKSARKLANQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 45 - DNA, 2742 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacggcatcattacctccaaaactaaatctctgatagaaggtagatttggcggtttcacgggcgcacgcaaatcagcgcgtaaattagctaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 46 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKLANQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 47 - DNA, 2673 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcatggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 48 - protein, 890 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 49 - DNA, 2751 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatcgaaggtcgttacggtggtttcatgacctctgaaaaatctcagaccccgctggttaccctgttcaaaaacgctatcatcaaaaacgcttacaaaaaaggtgaagcgctagcgggtggtggtggttctggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 50 - protein, 916 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 51 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 52 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 53 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 54 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSAALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 55 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatatgcggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 56 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKYAALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 57 - DNA, 2691 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcatatgcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 58 - protein, 896 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSYALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 59 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaatatgctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 60 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKYANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 61 - DNA, 2697 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaagcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 62 - protein, 898 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 63 - DNA, 2736 bp, Artificial Sequence
  Synthetic
ctcgggattgagggtcgttttggcggtttcacgggcgcacgcaaatcagcgcgtaaattagctaaccagactagtggcggtgggggtagtggcggtggcggttcgggcgggggtgggagccctaggggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 64 - protein, 911 aa, Artificial Sequence
  Synthetic
LGIEGRFGGFTGARKSARKLANQTSGGGGSGGGGSGGGGSPRGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 65 - DNA, 177 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctgcactagtgctgcagacgcacggtctagaatgataaaagctt

SEQ ID NO: 66 - DNA, 192 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctgcactagtgctgcagacgcacggtctagaatgataaaagctt

SEQ ID NO: 67 - DNA, 222 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctgcactagtgctgcagacgcacggtctagaatgataaaagctt

SEQ ID NO: 68 - DNA, 237 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctggtggtggtggttctgcactagtgctgcagacgcacggtctagaatgataaaagctt

SEQ ID NO: 69 - DNA, 228 bp, Artificial Sequence
  Synthetic
ggatccacgcacgtcgacggcatcattacctccaaaactaaatctctgatagaaggtagatttggcggtttcacgggcgcacgcaaatcagcgcgtaaattagctaaccaggcgctagcggctgaagctgctgctaaagaagctgctgctaaagaagctgctgctaaagctggtggcggtggttccgcactagtgctgcagacgcacggtctagaatgataaaagctt

SEQ ID NO: 70 - DNA, 2694 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 71 - protein, 897 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 72 - DNA, 2724 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaattagctaaccaggcgctagcgggtggtggtggttctggtggtggtggttctggtggtggtggttctggtggtggtggttctgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 73 - protein, 907 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 74 - DNA, 207 bp, Artificial Sequence
  Synthetic
ggatccacgcacgtcgacggcatcattacctccaaaactaaatctgacgatgacgataaatttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 75 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 76 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 77 - DNA, 207 bp, Artificial Sequence
  Synthetic
ggatccacgcacgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 78 - DNA, 2742 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 79 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 80 - DNA, 2673 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcctggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 81 - protein, 890 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 82 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatatggcggtttcacgggcgcacgcaaatcagcgcgtaaattagctaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 83 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 84 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatatggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 85 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 86 - DNA, 2889 bp, Artificial Sequence
  Synthetic
ggatccttggtacgagatgacgttgactatcaaattttccgcgactttgcggaaaataaaggtaagtttttcgtcggcgccacagacctgtccgtcaaaaataagagaggccagaacatcggtaacgcactgagcaacgtccctatgattgattttagtgtagcggacgttaataaacggattgcaaccgtcgttgatccgcagtatgctgtcagcgtcaaacatgctaaagcggaagttcatacgttctattacgggcaatataacggccataacgatgtggctgataaagaaaatgaatatcgcgtggtcgagcagaacaattacgaaccgcacaaagcgtggggcgcgagtaatttaggccgcctggaggactataacatggcccgtttcaataaattcgtgaccgaggtagcaccgatcgcccccacagatgctggtgggggcctggatacctacaaagataaaaaccgcttctctagcttcgtgcgcattggcgccggtcgtcagctcgtgtacgagaagggtgtctatcaccaggaaggtaatgaaaaggggtacgacctccgtgatttgtcccaggcgtatcgctacgctattgccggaaccccgtataaagatattaatatcgatcaaaccatgaataccgaaggcctaattggtttcgggaatcataataagcaatatagcgcagaagagctaaagcaggccctcagccaagatgcgttaaccaattacggagtgttaggcgatagcggcagtccgctgtttgccttcgataaacagaaaaatcaatgggtgtttctgggcacttatgattattgggccggatatggtaaaaagagctggcaggaatggaatatttataaaaaggaattcgcagacaaaatcaagcagcatgacaacgcaggtacggtgaaggggaacggcgaacatcactggaagacgaccggcacgaatagtcatatcggatcgacggccgttcgcctggcgaacaatgagggcgatgcaaacaatgggcaaaacgtgacctttgaggacaacggtaccctggtccttaaccagaacataaatcagggcgcgggaggcttgttctttaaaggcgactatactgttaagggagcaaacaatgacatcacctggttaggggccggtattgacgttgcggatggaaaaaaggtggtttggcaggttaaaaaccctaacggggaccggctggcaaaaatcggcaaagggacattggaaattaatggtaccggtgtgaatcagggtcagctgaaagtgggagatgggaccgtgattctgaaccagaaagcagacgctgacaaaaaggtgcaagcctttagccaagtaggaattgttagtggtcgtggcacactcgtcttgaactcaagcaaccaaataaatccggataacctgtactttggatttcgtggcggacgcctggatgctaacgggaatgatctgacctttgaacatatccgtaacgttgacgagggtgcgcgcatagttaatcataatactgaccatgcatcaactatcaccttgaccgggaaaagtctgattacaaacccaaactctctgtcagtacattccatccagaatgattatgatgaagacgattactcatactattaccggccgcgtagaccaattccacaaggtaaagatctttattacaaaaattaccgttattacgcattaaaatccggagggcggctgaatgcacctatgccggaaaatggcgtggccgaaaacaatgactggatttttatgggttatactcaagaagaggctcgcaaaaatgcaatgaaccataaaaataaccgaaggatcggtgatttcggcggatttttcgatgaggaaaatggtaaaggtcacaatggtgcgctgaatctaaattttaacggcaaaagtgcccagaaacgtttccttctgactggtggcgctaatctgaatggtaaaatcagtgtgacgcagggtaacgtgctgctttctggccggccaactccgcatgcacgtgattttgtaaataaatcgagcgctcgtaaagatgcgcatttttctaaaaataacgaggtcgtgtttgaagatgactggataaatcgcacctttaaagcggcagaaatcgcggttaatcagagtgcgagcttttcatcgggtaggaatgtatctgatattacagcaaacattacagccactgataatgcgaaggtcaacctgggttataaaaacggtgatgaagtttgtgttcgatcggattacacgggctatgttacctgcaacactggcaatctgtctgataaagcgcttaactcttttgacgccacgcgcattaacgggaatgtgaacctgaaccaaaacgctgccttggtacttggtaaggccgcgttgtggggtaaaattcagggccagggcaactcccgtgtgtctctgaaccagcactcgaagtggcacctgacgggggactcgcaggtgcacaacttgtccctggccgatagccatattcaccttaacaatgcgtccgatgcccagtcagctaataaatatcatacgatcaaaatcaatcacctctctggcaacggtcactttcactacttaacggatttagcaaaaaacttaggggataaagtcctggtaaaagaatcagcgagcggacattatcagttacatgtacagaacaaaacaggcgagccaaatcaggaaggccttgacttatttgatgcttcatcggtacaagatcgttccagactgttcgtttcactcgcgaatcactacgttgatctgggtgcgctgcgctatactataaagacggaaaatggcataacacgcctctataatccctatgccggtaacggccgtccggtgaaacctgctccctgcgtcgac

SEQ ID NO: 87 - DNA, 4296 bp, Artificial Sequence
  Synthetic
ggatccttggtacgagatgacgttgactatcaaattttccgcgactttgcggaaaataaaggtaagtttttcgtcggcgccacagacctgtccgtcaaaaataagagaggccagaacatcggtaacgcactgagcaacgtccctatgattgattttagtgtagcggacgttaataaacggattgcaaccgtcgttgatccgcagtatgctgtcagcgtcaaacatgctaaagcggaagttcatacgttctattacgggcaatataacggccataacgatgtggctgataaagaaaatgaatatcgcgtggtcgagcagaacaattacgaaccgcacaaagcgtggggcgcgagtaatttaggccgcctggaggactataacatggcccgtttcaataaattcgtgaccgaggtagcaccgatcgcccccacagatgctggtgggggcctggatacctacaaagataaaaaccgcttctctagcttcgtgcgcattggcgccggtcgtcagctcgtgtacgagaagggtgtctatcaccaggaaggtaatgaaaaggggtacgacctccgtgatttgtcccaggcgtatcgctacgctattgccggaaccccgtataaagatattaatatcgatcaaaccatgaataccgaaggcctaattggtttcgggaatcataataagcaatatagcgcagaagagctaaagcaggccctcagccaagatgcgttaaccaattacggagtgttaggcgatagcggcagtccgctgtttgccttcgataaacagaaaaatcaatgggtgtttctgggcacttatgattattgggccggatatggtaaaaagagctggcaggaatggaatatttataaaaaggaattcgcagacaaaatcaagcagcatgacaacgcaggtacggtgaaggggaacggcgaacatcactggaagacgaccggcacgaatagtcatatcggatcgacggccgttcgcctggcgaacaatgagggcgatgcaaacaatgggcaaaacgtgacctttgaggacaacggtaccctggtccttaaccagaacataaatcagggcgcgggaggcttgttctttaaaggcgactatactgttaagggagcaaacaatgacatcacctggttaggggccggtattgacgttgcggatggaaaaaaggtggtttggcaggttaaaaaccctaacggggaccggctggcaaaaatcggcaaagggacattggaaattaatggtaccggtgtgaatcagggtcagctgaaagtgggagatgggaccgtgattctgaaccagaaagcagacgctgacaaaaaggtgcaagcctttagccaagtaggaattgttagtggtcgtggcacactcgtcttgaactcaagcaaccaaataaatccggataacctgtactttggatttcgtggcggacgcctggatgctaacgggaatgatctgacctttgaacatatccgtaacgttgacgagggtgcgcgcatagttaatcataatactgaccatgcatcaactatcaccttgaccgggaaaagtctgattacaaacccaaactctctgtcagtacattccatccagaatgattatgatgaagacgattactcatactattaccggccgcgtagaccaattccacaaggtaaagatctttattacaaaaattaccgttattacgcattaaaatccggagggcggctgaatgcacctatgccggaaaatggcgtggccgaaaacaatgactggatttttatgggttatactcaagaagaggctcgcaaaaatgcaatgaaccataaaaataaccgaaggatcggtgatttcggcggatttttcgatgaggaaaatggtaaaggtcacaatggtgcgctgaatctaaattttaacggcaaaagtgcccagaaacgtttccttctgactggtggcgctaatctgaatggtaaaatcagtgtgacgcagggtaacgtgctgctttctggccggccaactccgcatgcacgtgattttgtaaataaatcgagcgctcgtaaagatgcgcatttttctaaaaataacgaggtcgtgtttgaagatgactggataaatcgcacctttaaagcggcagaaatcgcggttaatcagagtgcgagcttttcatcgggtaggaatgtatctgatattacagcaaacattacagccactgataatgcgaaggtcaacctgggttataaaaacggtgatgaagtttgtgttcgatcggattacacgggctatgttacctgcaacactggcaatctgtctgataaagcgcttaactcttttgacgccacgcgcattaacgggaatgtgaacctgaaccaaaacgctgccttggtacttggtaaggccgcgttgtggggtaaaattcagggccagggcaactcccgtgtgtctctgaaccagcactcgaagtggcacctgacgggggactcgcaggtgcacaacttgtccctggccgatagccatattcaccttaacaatgcgtccgatgcccagtcagctaataaatatcatacgatcaaaatcaatcacctctctggcaacggtcactttcactacttaacggatttagcaaaaaacttaggggataaagtcctggtaaaagaatcagcgagcggacattatcagttacatgtacagaacaaaacaggcgagccaaatcaggaaggccttgacttatttgatgcttcatcggtacaagatcgttccagactgttcgtttcactcgcgaatcactacgttgatctgggtgcgctgcgctatactataaagacggaaaatggcataacacgcctctataatccctatgccggtaacggccgtccggtgaaacctgctccctgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 88 - protein, 1431 aa, Artificial Sequence
  Synthetic
GSLVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLNQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGRLNAPMPENGVAENNDWIFMGYTQEEARKNAMNHKNNRRIGDFGGFFDEENGKGHNGALNLNFNGKSAQKRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNGRPVKPAPCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 89 - DNA, 1357 bp, Artificial Sequence
  Synthetic
gctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaatagaaggtagaagtgggcaccatcaccatcaccattaatgaaagctt

SEQ ID NO: 90 - DNA, 2745 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaatagaaggtagaagtgggcaccatcaccatcaccattaa

SEQ ID NO: 91 - protein, 914 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEIEGRSGHHHHHH

SEQ ID NO: 92 - DNA, 619 bp, Artificial Sequence
  Synthetic
gctagcgggcggtggcggtagcggcggtggcggtagcggcggtggcggtagcgcactagtgctgcagtgtatcaatctggattgggacgtaatccgtgataagaccaaaacaaaaatcgagtctttgaaagaacacggcccgatcaaaaataagatgtctgaatcacccaataaaactgtttcggaggaaaaagcgaaacagtatttggaagagtttcatcaaaccgcgcttgaacatccggagctcagtgaactgaaaacagtgacgggaacgaatcctgtttttgcaggcgcaaactatgcggcttgggccgtgaatgttgcccaagtaattgatagtgagaccgcagacaacctggaaaagacgaccgcagcgttaagcattttaccggggattggttccgtgatgggtatagcggatggagcggtccaccataacactgaggaaattgtcgcccagtcaatcgctctgagttccctgatggttgcacaggctatcccactcgtgggggaactggttgacataggtttcgccgcctacaacttcgtagaaagcattattaatctttttcaggtggtgcataacagctacaaccgccctctagaatgataaaagctt

SEQ ID NO: 93 - DNA, 1971 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagatacggtggtttcctggcgctagcgggcggtggcggtagcggcggtggcggtagcggcggtggcggtagcgcactagtgctgcagtgtatcaatctggattgggacgtaatccgtgataagaccaaaacaaaaatcgagtctttgaaagaacacggcccgatcaaaaataagatgtctgaatcacccaataaaactgtttcggaggaaaaagcgaaacagtatttggaagagtttcatcaaaccgcgcttgaacatccggagctcagtgaactgaaaacagtgacgggaacgaatcctgtttttgcaggcgcaaactatgcggcttgggccgtgaatgttgcccaagtaattgatagtgagaccgcagacaacctggaaaagacgaccgcagcgttaagcattttaccggggattggttccgtgatgggtatagcggatggagcggtccaccataacactgaggaaattgtcgcccagtcaatcgctctgagttccctgatggttgcacaggctatcccactcgtgggggaactggttgacataggtttcgccgcctacaacttcgtagaaagcattattaatctttttcaggtggtgcataacagctacaaccgccctctagaatga

SEQ ID NO: 94 - protein, 656 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFLALAGGGGSGGGGSGGGGSALVLQCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPLE

SEQ ID NO: 95 - DNA, 1329 bp, Artificial Sequence
  Synthetic
ggatccatgcctattactattaacaattttcgttatagcgatcccgtcaacaatgacaccattatcatgatggaaccgccatattgcaaaggactggacatttactataaagccttcaagattactgaccgcatttggattgttccagagcgttacgagttcgggacgaaaccagaagattttaacccgccttcatcgctgatcgaaggagcatcagagtattacgatccgaactatctgcgtacggacagcgataaagaccgcttcttacagaccatggtcaaactttttaaccgtattaagaacaatgtggccggagaagcactcttggataagattatcaacgcgattccatacctgggcaattcttacagcctgctggataaatttgacacaaatagtaattcagtcagctttaacctgttagaacaagatccgagtggcgcaaccacgaagtctgccatgctgacaaatctgatcatttttggtccaggtcctgtactgaataaaaatgaagtacgcggcatcgttctccgcgtggacaataagaactacttcccatgccgtgacggcttcggttcgatcatgcagatggctttctgtccggagtacgttccgacgtttgataatgttattgagaatatcacgagtttaacaatcggtaagtcaaaatattttcaagatccggcccttctccttatgcatgaactgattcacgtgctgcacggcttatatggtatgcaagtgtcctcgcatgaaatcattccgtccaaacaggaaatttatatgcagcatacctacccgatttcagctgaagagttgtttacgtttggtggccaggacgcgaatttgatctccatcgacatcaaaaacgatctgtatgagaaaacattaaatgactataaagcgattgcgaacaaactgtctcaggtgactagctgcaacgatcctaacattgatattgattcctacaaacaaatttatcaacagaaataccagttcgataaagacagcaatggtcagtatatcgtaaacgaagataaatttcagatcctgtataacagcattatgtatggctttaccgaaattgagttggggaagaaatttaacattaaaacccgtctgtcttattttagtatgaaccatgatccggtgaaaatccccaatctgcttgatgataccatttataatgataccgaagggttcaacattgaatctaaggatctgaaatccgaatacaaaggccaaaatatgcgtgttaatactaacgctttccgtaatgttgatggtagtggactcgtctcgaaactgattgggttgtgtgtcgac

SEQ ID NO: 96 - DNA, 2736 bp, Artificial Sequence
  Synthetic
ggatccatgcctattactattaacaattttcgttatagcgatcccgtcaacaatgacaccattatcatgatggaaccgccatattgcaaaggactggacatttactataaagccttcaagattactgaccgcatttggattgttccagagcgttacgagttcgggacgaaaccagaagattttaacccgccttcatcgctgatcgaaggagcatcagagtattacgatccgaactatctgcgtacggacagcgataaagaccgcttcttacagaccatggtcaaactttttaaccgtattaagaacaatgtggccggagaagcactcttggataagattatcaacgcgattccatacctgggcaattcttacagcctgctggataaatttgacacaaatagtaattcagtcagctttaacctgttagaacaagatccgagtggcgcaaccacgaagtctgccatgctgacaaatctgatcatttttggtccaggtcctgtactgaataaaaatgaagtacgcggcatcgttctccgcgtggacaataagaactacttcccatgccgtgacggcttcggttcgatcatgcagatggctttctgtccggagtacgttccgacgtttgataatgttattgagaatatcacgagtttaacaatcggtaagtcaaaatattttcaagatccggcccttctccttatgcatgaactgattcacgtgctgcacggcttatatggtatgcaagtgtcctcgcatgaaatcattccgtccaaacaggaaatttatatgcagcatacctacccgatttcagctgaagagttgtttacgtttggtggccaggacgcgaatttgatctccatcgacatcaaaaacgatctgtatgagaaaacattaaatgactataaagcgattgcgaacaaactgtctcaggtgactagctgcaacgatcctaacattgatattgattcctacaaacaaatttatcaacagaaataccagttcgataaagacagcaatggtcagtatatcgtaaacgaagataaatttcagatcctgtataacagcattatgtatggctttaccgaaattgagttggggaagaaatttaacattaaaacccgtctgtcttattttagtatgaaccatgatccggtgaaaatccccaatctgcttgatgataccatttataatgataccgaagggttcaacattgaatctaaggatctgaaatccgaatacaaaggccaaaatatgcgtgttaatactaacgctttccgtaatgttgatggtagtggactcgtctcgaaactgattgggttgtgtgtcgacggcatcattacctccaaaactaaatctctgatagaaggtagatttggcggtttcacgggcgcacgcaaatcagcgcgtaaacgtaagaaccaggcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 97 - protein, 911 aa, Artificial Sequence
  Synthetic
GSMPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 98 - DNA, 180 bp, Artificial Sequence
  Synthetic
ggatccacgcacgtcgacgcgattgatggtcgttttggcggtttcacgggcgcacgcaaatcagcgcgtaaacgtaagaaccaggcgctagcgggcggtggcggtagcggcggtggcggtagcggcggtggcggtagcgcactagtgctgcagacgcacggtctagaatgataaaagctt

SEQ ID NO: 99 - DNA, 2715 bp, Artificial Sequence
  Synthetic
ggatccgaattcatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgattgatggtcgttttggcggtttcacgggcgcacgcaaatcagcgcgtaaacgtaagaaccaggcgctagcgggcggtggcggtagcggcggtggcggtagcggcggtggcggtagcgcactagtgctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactag

SEQ ID NO: 100 - protein, 904 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 101 - protein, 17 aa, Artificial Sequence
  Synthetic
YGGFLRRIRPKLKWDNQ

SEQ ID NO: 102 - DNA, 2709 bp, Artificial Sequence
  Synthetic
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatatggaggttttttgagaaggatacgaccaaaattaaagtgggataatcaagcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 103 - protein, 902 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 104 - protein, 892 aa, Artificial Organism
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 105 - protein, 897 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 106 - protein, 907 aa, Artificial Sequence
  Synthetic
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 107 - protein, 913 aa, Artificial Sequence
  Synthetic
GSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSDDDDKYGGFLRRIRPKLKWDNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLD

SEQ ID NO: 108 - protein, 1432 aa, Artificial Sequence
  Synthetic
GSLVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLNQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGRLNAPMPENGVAENNDWIFMGYTQEEARKNAMNHKNNRRIGDFGGFFDEENGKGHNGALNLNFNGKSAQKRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNGRPVKPAPCVDGIITSKTKSLDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 109 - protein, 911 aa, Artificial Sequence
  Synthetic
GSMPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 110 - protein, 912 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 111 - protein, 909 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAAEAAAKEAAAKEAAAKAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 112 - protein, 910 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKYGGFLRRIRPKLKWDNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 113 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 114 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 115 - protein, 912 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 116 - protein, 908 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 117 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 118 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 119 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 120 - protein, 22 aa, Artificial Sequence
  Synthetic sequence
YGGFMRRVGRPEWWMDYQKRYG

SEQ ID NO: 121 - protein, 15 aa, Artificial Sequence
  Synthetic sequence
VGRPEWWMDYQKRYG

SEQ ID NO: 122 - DNA, 2724 bp, Artificial Sequence
  Synthetic sequence
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaatacggtggtttcatgcgtcgtgtcggtcgcccggaatggtggatggactatcaaaagcgttacggcgcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagactag

SEQ ID NO: 123 - protein, 907 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFMRRVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 124 - protein, 902 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVVGRPEWWMDYQKRYG

SEQ ID NO: 125 - protein, 900 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 126 - protein, 31 aa, Artificial Sequence
  Synthetic sequence
YGGFMTSEKSQTPLVTLFKNAIIKNAYKKGE

SEQ ID NO: 127 - protein, 924 aa, Artificial Sequence
  Synthetic sequence
GSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYGGFMTSEKSQTPLVTLFKNAIIKNAYKKGEALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLD

SEQ ID NO: 128 - protein, 924 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSLIEGRYGGFMTSEKSQTPLVTLFKNAIIKNAYKKGEALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 129 - protein, 9 aa, Artificial Sequence
  Synthetic sequence
RPPGFSPFR

SEQ ID NO: 130 - protein, 8 aa, Artificial Sequence
  Synthetic sequence
RPPGFSPF

SEQ ID NO: 131 - DNA, 2697 bp, Artificial Sequence
  Synthetic sequence
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaaggcggtggcggtagcggcggtggcggtagcggcggtggcggtagcgcactagtgcgtccgccgggtttctctccgttccgttagaagctt

SEQ ID NO: 132 - protein, 896 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPFR

SEQ ID NO: 133 - protein, 895 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPF

SEQ ID NO: 134 - protein, 11 aa, Artificial Sequence
  Synthetic sequence
RPKPQQFFGLM

SEQ ID NO: 135 - protein, 11 aa, Artificial Sequence
  Synthetic sequence
KRAKFMMFFGL

SEQ ID NO: 136 - protein, 898 aa, Artificial Sequence
  Synthetic sequence
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVKRAKFMMFFGL

SEQ ID NO: 137 - protein, 910 aa, Artificial Sequence
  Synthetic sequence
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKFGGFTGARKSARKRKNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLD

SEQ ID NO: 138 - protein, 910 aa, Artificial Sequence
  Synthetic sequence
GSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKFGGFTGARKSARKRKNQALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLD

SEQ ID NO: 139 - DNA, 1323 bp, Artificial Sequence
  Synthetic sequence
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgac

SEQ ID NO: 140 - DNA, 1260 bp, Artificial Sequence
  Synthetic sequence
ctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaatctagactagaagctt

SEQ ID NO: 141 - protein, 906 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALD

SEQ ID NO: 142 - protein, 909 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALD

SEQ ID NO: 143 - protein, 903 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLD

SEQ ID NO: 144 - protein, 906 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVVGRPEWWMDYQKRYG

SEQ ID NO: 145 - protein, 912 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 146 - protein, 919 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFMRRVGRPEWWMDYQKRYGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 147 - protein, 931 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 148 - protein, 928 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFMTSEKSQTPLVTLFKNAIIKNAYKKGEALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 149 - protein, 936 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSLIEGRYGGFMTSEKSQTPLVTLFKNAIIKNAYKKGEALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 150 - protein, 936 aa, Artificial Sequence
  Synthetic sequence
MGSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYGGFMTSEKSQTPLVTLFKNAIIKNAYKKGEALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEALASGHHHHHH

SEQ ID NO: 151 - protein, 900 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVRPPGFSPFR

SEQ ID NO: 152 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 153 - protein, 910 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 154 - protein, 924 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 155 - protein, 920 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 156 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 157 - protein, 924 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWANQALAGGGGSGGGGSGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 158 - protein, 922 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKYGGFLRRIRPKLKWDNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 159 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKWANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 160 - protein, 910 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRRRRKLKALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 161 - protein, 921 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLRRIRPKLKWDNQALAAEAAAKEAAAKEAAAKAGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 162 - protein, 914 aa, Artificial Sequence
  Synthetic sequence
MGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKYGGFLGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 163 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 164 - protein, 928 aa, Artificial Sequence
  Synthetic sequence
ISEFGSEFMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRFGGFTGARKSARKRKNQALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEALASGHHHHHH

SEQ ID NO: 165 - protein, 925 aa, Artificial Sequence
  Synthetic sequence
ISEFGSMTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKFGGFTGARKSARKRKNQALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEALASGHHHHHH

SEQ ID NO: 166 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRFGGFTGARKSARKLANQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 167 - protein, 922 aa, Artificial Sequence
  Synthetic sequence
MGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKFGGFTGARKSARKRKNQALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEALASGHHHHHH

SEQ ID NO: 168 - protein, 917 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRYGGFTGARKSARKRKNQALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEALASGHHHHHH

SEQ ID NO: 169 - protein, 902 aa, Artificial Sequence
  Synthetic sequence
ISEFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVKRAKFMMFFGL

SEQ ID NO: 170 - protein, 23 aa, Influenza virus
GLFGAIAGFIENGWEGMIDGWYG

SEQ ID NO: 171 - protein, 5 aa, Artificial Sequence
  chemically synthesized enterokinase cleavage site
DDDDK

SEQ ID NO: 172 - protein, 8 aa, Artificial Sequence
  chemically synthesized Factor Xa cleavage site
IEGRIDGR

SEQ ID NO: 173 - protein, 7 aa, Artificial Sequence
  chemically synthesized tobacco etch virus cleavage site
ENLYFQG

SEQ ID NO: 174 - protein, 6 aa, Artificial Sequence
  chemically synthesized thrombin cleavage site
LVPRGS

SEQ ID NO: 175 - protein, 8 aa, Artificial Sequence
  chemically synthesized PreScission cleavage site
LEVLFQGP

SEQ ID NO: 176 - DNA, 48 bp, Artificial Sequence
  chemically synthesized PCR primer
tccaaaactaaatctctgatagaaggtagaaacaaagcgctgaacgac

SEQ ID NO: 177 - DNA, 25 bp, Artificial Sequence
  chemically synthesized PCR primer
cttgatgtactctgtgaacgtgctc

SEQ ID NO: 178 - DNA, 48 bp, Artificial Sequence
  chemically synthesized PCR primer
gtcgttcagcgctttgtttctaccttctatcagagatttagttttgga

SEQ ID NO: 179 - DNA, 24 bp, Artificial Sequence
  chemically synthesized PCR primer
atggagttcgttaacaaacagttc

SEQ ID NO: 180 - protein, 25 aa, Artificial Sequence
  chemically synthesized activation loop
CVRGIITSKTKSLDKGYNKALNDLC

SEQ ID NO: 181 - protein, 5 aa, Artificial Sequence
  chemically synthesized met-enkephalin peptide
YGGFM

SEQ ID NO: 182 - protein, 13 aa, Artificial Sequence
  chemically synthesized peptide linker
ALAGGGGSALVLQ

SEQ ID NO: 183 - protein, 18 aa, Artificial Sequence
  chemically synthesized peptide linker
ALAGGGGSGGGGSALVLQ

SEQ ID NO: 184 - protein, 28 aa, Artificial Sequence
  chemically synthesized peptide linker
ALAGGGGSGGGGSGGGGSGGGGSALVLQ

SEQ ID NO: 185 - protein, 33 aa, Artificial Sequence
  chemically synthesized peptide linker
ALAGGGGSGGGGSGGGGSGGGGSGGGGSALVLQ

SEQ ID NO: 186 - protein, 30 aa, Artificial Sequence
  chemically synthesized peptide linker
ALAAEAAAKEAAAKEAAAKAGGGGSALVLQ

What is claimed is:

1. A non-cytotoxic protein conjugate for inhibition or reduction of exocytic fusion in a nociceptive sensory afferent cell, comprising:

(i) a Targeting Moiety (TM),
  wherein said TM binds to a Binding site on a nociceptive sensory afferent cell, wherein said Binding site undergoes endocytosis to be incorporated into an endosome within the nociceptive sensory afferent cell, and wherein the TM is nociceptin;

(ii) a non-cytotoxic protease or a fragment thereof,
  wherein the protease or protease fragment cleaves a protein of the exocytic fusion apparatus of said nociceptive sensory afferent cell and wherein the non-cytotoxic protease or fragment thereof is selected from a clostridial neurotoxin; and (iii) a Translocation Domain,
  wherein the Translocation Domain translocates the protease or protease fragment from within the endosome, across the endosomal membrane, and into the cytosol of the nociceptive sensory afferent cell and wherein the Translocation Domain is a botulinum $H_N$ domain;
  wherein said conjugate comprises an amino acid sequence selected from the group consisting of SEQ ID NOs:137, 138, 142, and 163-168.

2. The non-cytotoxic protein conjugate of claim 1, wherein the TM binds specifically to $ORL_1$ receptor.

3. The non-cytotoxic protein conjugate of claim 1, wherein the nociceptive sensory afferent cell is a primary nociceptive sensory afferent cell.

4. A pharmaceutical composition comprising the non-cytotoxic protein conjugate according to claim 1 and a pharmaceutically acceptable carrier.

5. A method for treating or ameliorating pain in a subject, comprising administering to said subject a therapeutically effective amount of the pharmaceutical composition according to claim 4.

6. The method according to claim 5, wherein the pain is chronic pain selected from the group consisting of neuropathic pain, inflammatory pain, headache pain, somatic pain, visceral pain and referred pain.

7. A method for treating or ameliorating pain in a subject, comprising administering to said subject a therapeutically effective amount of the non-cytotoxic protein conjugate according to claim 1.

8. The method according to claim 7, wherein the pain is chronic pain selected from the group consisting of neuropathic pain, inflammatory pain, headache pain, somatic pain, visceral pain and referred pain.

* * * * *